United States Patent
Jarjour et al.

(10) Patent No.: US 10,428,142 B2
(45) Date of Patent: *Oct. 1, 2019

(54) MULTIPARTITE SIGNALING PROTEINS AND USES THEREOF

(71) Applicant: BLUEBIRD BIO, INC., Cambridge, MA (US)

(72) Inventors: Jordan Jarjour, Seattle, WA (US); Alexander Astrakhan, Seattle, WA (US); Michael Certo, Brookline, MA (US)

(73) Assignee: bluebird bio, Inc., Cambridge, MA (US)

( * ) Notice: Subject to any disclaimer, the term of this patent is extended or adjusted under 35 U.S.C. 154(b) by 0 days.

This patent is subject to a terminal disclaimer.

(21) Appl. No.: 14/608,098

(22) Filed: Jan. 28, 2015

(65) Prior Publication Data

US 2015/0266973 A1 Sep. 24, 2015

Related U.S. Application Data

(63) Continuation-in-part of application No. PCT/US2014/047852, filed on Jul. 23, 2014.

(60) Provisional application No. 61/934,092, filed on Jan. 31, 2014, provisional application No. 61/859,697, filed on Jul. 29, 2013.

(51) Int. Cl.

| | |
|---|---|
| *C12N 5/16* | (2006.01) |
| *C12N 5/0783* | (2010.01) |
| *C07K 16/28* | (2006.01) |
| *A61K 35/17* | (2015.01) |
| *A61K 39/00* | (2006.01) |
| *A61K 45/06* | (2006.01) |
| *C07K 14/705* | (2006.01) |
| *C07K 16/40* | (2006.01) |
| *C12N 9/12* | (2006.01) |
| *C12N 9/90* | (2006.01) |
| *C07K 14/725* | (2006.01) |
| *C07K 14/73* | (2006.01) |
| *C07K 14/735* | (2006.01) |
| *C12N 9/06* | (2006.01) |
| *C12N 9/16* | (2006.01) |
| *C12N 15/85* | (2006.01) |
| *C07H 21/04* | (2006.01) |

(52) U.S. Cl.
CPC ........ *C07K 16/2803* (2013.01); *A61K 35/17* (2013.01); *A61K 39/0005* (2013.01); *A61K 45/06* (2013.01); *C07K 14/7051* (2013.01); *C07K 14/7056* (2013.01); *C07K 14/70503* (2013.01); *C07K 14/70514* (2013.01); *C07K 14/70517* (2013.01); *C07K 14/70521* (2013.01); *C07K 14/70535* (2013.01); *C07K 14/70578* (2013.01); *C07K 14/70596* (2013.01); *C07K 16/2896* (2013.01); *C07K 16/40* (2013.01); *C12N 9/003* (2013.01); *C12N 9/12* (2013.01); *C12N 9/16* (2013.01); *C12N 9/90* (2013.01); *C12N 15/85* (2013.01); *C12Y 207/11001* (2013.01); *C12Y 502/01008* (2013.01); *C07H 21/04* (2013.01); *C07K 2317/622* (2013.01); *C07K 2319/03* (2013.01); *C07K 2319/70* (2013.01); *C12N 2510/00* (2013.01)

(58) Field of Classification Search
None
See application file for complete search history.

(56) References Cited

U.S. PATENT DOCUMENTS

| | | | |
|---|---|---|---|
| 5,871,753 | A | 2/1999 | Crabtree et al. |
| 5,910,573 | A | 6/1999 | Pluckthun et al. |
| 6,291,158 | B1 | 9/2001 | Winter et al. |
| 6,291,161 | B1 | 9/2001 | Lerner et al. |
| 6,423,498 | B1 | 7/2002 | Markland et al. |
| 6,649,595 | B2 | 11/2003 | Clackson et al. |
| 6,972,193 | B1 | 12/2005 | Crabtree et al. |
| 9,587,020 | B2 * | 3/2017 | Wu .............. C07K 16/2803 |
| 2007/0065431 | A1 | 3/2007 | Coia et al. |
| 2013/0287752 | A1 * | 10/2013 | Davila ............ C07K 16/44 424/93.71 |

FOREIGN PATENT DOCUMENTS

| | | | |
|---|---|---|---|
| JP | 2002-503667 A | | 2/2002 |
| JP | 2002-508971 A | | 3/2002 |
| WO | WO 1999/036553 A2 | | 7/1999 |
| WO | WO 1999/041258 A1 | | 8/1999 |
| WO | WO 2006/072620 A1 | | 7/2006 |
| WO | WO 2006/095164 A1 | | 9/2006 |
| WO | WO 2007/098934 A1 | | 9/2007 |
| WO | WO 2012/082841 A2 | | 6/2012 |

(Continued)

OTHER PUBLICATIONS

Leung, Wai-Hang et al.Small molecule-regulated antigen recognition system for inducible T cell targeting of cancer cells.Bluebird Bio, Cambridge, MA, United States. Molecular Therapy, (Apr. 2016) vol. 24, Supp. SUPPL. 1,pp. S110. Abstract No. 277.*

(Continued)

*Primary Examiner* — Maria G Leavitt
(74) *Attorney, Agent, or Firm* — Cooley LLP

(57) ABSTRACT

The present disclosure relates to compositions and methods for using cells having chemically-induced fusion protein complexes to spatially and temporally control immune cell signal initiation and downstream responses for treating disease.

4 Claims, 34 Drawing Sheets

Specification includes a Sequence Listing.

(56) References Cited

FOREIGN PATENT DOCUMENTS

| WO | WO 2014/127261 A1 | 8/2014 |
|---|---|---|
| WO | WO 2015/017214 A1 | 2/2015 |

OTHER PUBLICATIONS

Schlessinger et al., Cell Signaling by Receptor Tyrosine Kinases Cell, vol. 103, 211-225, Oct. 13, 2000.*
Grunberg Building blocks for protein interaction devices Nucleic Acids Research, 2010, vol. 38, No. 8 2645-2662.*
Belshaw et al., Controlling protein association and subcellular localization with a synthetic ligand that induces heterodimerization of proteins Proc. Natl. Acad. Sci. USA vol. 93, pp. 4604-4607, May 1996.*
Bayle et al., Rapamycin Analogs with Differential Binding Specificity Permit Orthogonal Control of Protein Activity Chemistry & Biology 13, 99-107, Jan. 2006.*
Brentjens et al., CD19-Targeted T Cells Rapidly Induce Molecular Remissions in Adults with Chemotherapy-Refractory Acute Lymphoblastic Leukemia Science Translational Medicine Mar. 20, 2013: Abstract.*
Curran et al Chimeric Antigen Receptors for T cell Immunotherapy: Current Understanding and Future Direction J Gene Med. Jun. 2012; 14(6): 405-415.*
Tal et al An NCR1-based chimeric receptor endows T-cells with multiple anti-tumor specificities 2014; Oncotarget, pp. 10949-10958.*
Dotti et al Immunol Rev. Jan. 2014;257(1):107-26.Design and development of therapies using chimeric antigen receptor-expressing T cells.*
Abate-Daga Oncolytics (2016) CAR models: next-geneartion CAR modifications for enhanced T-cell funcion pp. 1-7.*
Alder, M. et al., "Antibody responses of variable lymphocyte receptors in the lamprey", Nat Immunol. (2008); 9(3):319-327.
Baral, et al., "Experimental therapy of African trypanosomiasis with a nanobody-conjugated human trypanolytic factor", Nat Med. (2006); 12(5): 580-584.
Barthelemy, PA. et al., "Comprehensive analysis of the factors contributing to the stability and solubility of autonomous human VH domains", J Biol Chem. (2008); 283(6):3639-3654.
Beavil, A. et al., "Alpha-helical coiled-coil stalks in the low-affinity receptor for IgE (Fc epsilon RII/CD23) and related C-type lectins", Proc Natl Acad Sci U S A. (1992); 89(2):753-757.
Beste, G. et al., "Small antibody-like proteins with prescribed ligand specificities derived from the lipocalin fold", Proc Natl Acad Sci U S A. (1999); 96(5):1898-903.
Binz, HK, et al., "Designing repeat proteins: well-expressed, soluble and stable proteins from combinatorial libraries of consensus ankyrin repeat proteins", J. Mol. Biol. (2003); 332(2): 489-503.
Binz, HK, et al., "Engineering novel binding proteins from nonimmunoglobulin domains", Nat. Biotechnol. (2005); 23(10): 1257-1268.
Brentjens, R. et al.,"Safety and persistence of adoptively transferred autologous CD19-targeted T cells in patients with relapsed or chemotherapy refractory B-cell leukemias", Blood (2011); 118(18): 4817-4828.
Brown, E. et al., "A mammalian protein targeted by G1-arresting rapamycin-receptor complex", Nature (1994); 369(6483): 756-758.
Capon, D. et al., "Designing CD4 immunoadhesins for AIDS therapy", Nature (1989); 337(6207): 525-531.
Carpenito, C. et. al., "Control of large, established tumor xenografts with genetically retargeted human T cells containing CD28 and CD137 domains", Proc Natl Acad Sci USA (2009); 106(9):3360-3365.
Challita, P. et al., "Multiple modifications in cis elements of the long terminal repeat of retroviral vectors lead to increased expression and decreased DNA methylation in embryonic carcinoma cells", J Virol. (1995) 69(2): 748-755.

Cortez-Retamozo, V. et al., "Efficient cancer therapy with a nanobody-based conjugate", Cancer Res. (2004); 64(8):2853-2857.
Craik, D. et al., "Plant cyclotides: A unique family of cyclic and knotted proteins that defines the cyclic cystine knot structural motif", J. Mol. Biol. (1999); 294(5): 1327-1336.
Donnelly, M. et al., "The cleavage activities of foot-and-mouth disease virus 2A site-directed mutants and naturally occurring '2A-like' sequences", J Gen Virol. (2001); 82 (Pt 5):1027-1041.
Duong, C. et al., "Enhancing the specificity of T-cell cultures for adoptive immunotherapy of cancer", Immunotherapy (2011); 3(1): 33-48.
Ghahroudi, et al., "Selection and identification of single domain antibody fragments from camel heavy-chain antibodies", FEBS Lett. (1997); 414(3):521-526.
Grupp, S.A. et al., "Chimeric antigen receptor-modified T cells for acute lymphoid leukemia", N Engl J Med. (2013); 368(16): 1509-1518.
Hackel, B. et al., "Picomolar affinity fibronectin domains engineered utilizing loop length diversity, recursive mutagenesis, and loop shuffling", J Mol Biol. (2008); 381(5):1238-1252.
Hamers-Casterman, C. et al., "Naturally occurring antibodies devoid of light chains", Nature (1993); 363(6428):446-448.
Herrin, B. et al., "Structure and specificity of lamprey monoclonal antibodies", Proc Natl Acad Sci U S A. (2008); 105(6):2040-2045.
Hu, S. et al., "Minibody: A novel engineered anti-carcinoembryonic antigen antibody fragment (single-chain Fv-CH3) which exhibits rapid, high-level targeting of xenografts" Cancer Res. (1996); 56(13):3055-3061.
Huang,C. et al.,"Scorpion-toxin mimics of CD4 in complex with human immunodeficiency virus gp120 crystal structures, molecular mimicry, and neutralization breadth", Structure (2005); 13(5):755-768.
Hoet, R. et al., "Generation of high-affinity human antibodies by combining donor-derived and synthetic complementarity-determining-region diversity", Nat Biotechnol. (2005); 23(3):344-348.
Hsu, C. et al., "Primary human T lymphocytes engineered with a codon-optimized IL-15 gene resist cytokine withdrawal-induced apoptosis and persist long-term in the absence of exogenous cytokine", J Immunol. (2005); 175(11):7226-7234.
International Application No. PCT/US2014/047852, International Search Report and Written Opinion dated Nov. 21, 2014, 11 pages.
International Application No. PCT/US2014/047852, International Preliminary Report on Patentability dated Feb. 2, 2016, 8 pages.
Irion, S. et al., "Identification and targeting of the ROSA26 locus in human embryonic stem cells", Nat Biotechnol. (2007); 25(12):1477-1482.
Janeway,C. et al., "The Immune System in Health and Disease",Immunobiology (1999); 4th edition, Current Biology Publications p. 148, 149, and 172.
Jespers, L. et al., "Aggregation-resistant domain antibodies selected on phage by heat denaturation", Nat Biotechnol. (2004); 22(9):1161-1165.
June, C. et al., "T-cell therapy at the threshold", Nat Biotechnol. (2012); 30(7): 611-614.
Kalos, et al., "T Cells with Chimeric Antigen Receptors Have Potent Antitumor Effects and Can Establish Memory in Patients with Advanced Leukemia", Sci Transl Med. (2011); 3(95): 95ra73. doi:10.1126/scitranslmed.3002842.
Kalos, M. et al., "T cells with chimeric antigen receptors have potent antitumor effects and can establish memory in patients with advanced leukemia", Sci Transl Med. (2011); 3(95):95ra73.
Kay, J.E., "Structure-function relationships in the FK506-binding protein (FKBP) family of peptidylprolyl cis-trans isomerases", Biochem J. (1996); 314 ( Pt 2):361-385.
Kochenderfer, J. et al., "Treating B-cell cancer with T cells expressing anti-CD19 chimeric antigen receptors", Nat Rev Clin Oncol. (2013); 10(5):267-276.
Kochenderfer, J. et al., "B-cell depletion and remissions of malignancy along with cytokine-associated toxicity in a clinical trial of anti-CD19 chimeric-antigen-receptor-transduced T cells", Blood (2012); 119(12):2709-2720.

(56) References Cited

OTHER PUBLICATIONS

Kowolik, C. et al., "CD28 costimulation provided through a CD19-specific chimeric antigen receptor enhances in vivo persistence and antitumor efficacy of adoptively transferred T cells", Cancer Res. (2006); 66(22): 10995-11004.
Lee, S. et al., "Design of a binding scaffold based on variable lymphocyte receptors of jawless vertebrates by module engineering", Proc Natl Acad Sci U S A. (2012); 109(9):3299-3304.
Main, E. et al., "Design of stable alpha-helical arrays from an idealized TPR motif", Structure (2003); 11(5):497-508.
Manzke,O. et al., "CD3X anti-nitrophenyl bispecific diabodies: universal immunotherapeutic tools for retargeting T cells to tumors", Int J Cancer. (1999); 82(5):700-708.
Martin, L. et al., "Rational design of a CD4 mimic that inhibits HIV-1 entry and exposes cryptic neutralization epitopes", Nat. Biotechnol. (2003); 21(1): 71-76.
Milone, M. et al., "Chimeric receptors containing CD137 signal transduction domains diate enhanced survival of T cells and increased antileukemic efficacy in vivo", Mol Ther. (2009); 17(8):1453-64.
Nguyen, V. et al., "Heavy-chain antibodies in Camelidae; a case of evolutionary innovation", Immunogenetics (2002); 54(1): 39-47.
Nguyen, V. et al., "The specific variable domain of camel heavy-chain antibodies is encoded in the germline", J. Mol. Biol. (1998); 275(3): 413-418.
Nord, K. et al., "A combinatorial library of an alpha-helical bacterial receptor domain", Protein Eng. (1995); 8(6): 601-608.
Nord, K. et al., "Binding proteins selected from combinatorial libraries of an alpha-helical bacterial receptor domain", Nat. Biotechnol. (1997); 15(8): 772-777.
Nord, K. et al., "Recombinant human factor VIII-specific affinity ligands selected from phage-displayed combinatorial libraries of protein A", Eur J Biochem. (2001); 268(15):4269-4277.
Parker, M. "Antibody mimics based on human fibronectin type three domain engineered for thermostability and high-affinity binding to vascular endothelial growth factor receptor two", Protein Eng Des Sel. (2005); 18(9):435-444.
Pule, M.A. et al., "A chimeric T cell antigen receptor that augments cytokine release and supports clonal expansion of primary human T cells", Mol Ther. (2005); 12(5):933-941. Epub Jun. 23, 2005.
Quintarelli, C. "Co-expression of cytokine and suicide genes to enhance the activity and safety of tumor-specific cytotoxic T lymphocytes", Blood (2007); 110(8):2793-2802.
Restifo, N.P. et al., "Adoptive immunotherapy for cancer: harnessing the T cell response"; Nat Rev Immunol. (2012); 12(4):269-281.
Richards, J. et al., "Engineered fibronectin type III domain with a RGDWXE sequence binds with enhanced affinity and specificity to human avb3 integrin", J. Mol. Biol. (2003); 326(5): 1475-1488.
Roux, K. et al., "Structural analysis of the nurse shark (new) antigen receptor (NAR): molecular convergence of NAR and unusual mammalian immunoglobulins", Proc Natl Acad Sci U S A. (1998); 95(20):11804-11809.
Ryan, M. et al., "Virus-encoded proteinases of the picornavirus super-group", J Gen Virol. (1997); 78 (Pt 4): 699-723.
Sato, A. et al, "Genes encoding putative natural killer cell C-type lectin receptors in teleostean fishes", Proc Natl Acad Sci U S A. (2003); 100(13):7779-7784.
Schonfeld, D. et al., "An engineered lipocalin specific for CTLA-4 reveals a combining site with structural and conformational features similar to antibodies", Proc Natl Acad Sci U S A. (2009); 106(20):8198-8203.
Skerra, A., "Alternative binding proteins: anticalins—harnessing the structural plasticity of the lipocalin ligand pocket to engineer novel binding activities", FEBS J. (2008); 275(11):2677-2683.
Standaert, R. et al., "Molecular cloning and overexpression of the human FK506-binding protein FKBP", Nature (1990); 346(6285): 671-674.
Stephan, M. et al., "T cell-encoded CD80 and 4-1BBL induce auto- and transcostimulation, resulting in potent tumor rejection", Nat Med. (2007); 13(12): 1440-1449.
Stumpp, M. et al., "Designing repeat proteins: modular leucine-rich repeat protein libraries based on the mammalian ribonuclease inhibitor family", J. Mol. Biol. (2003); 332(2): 471-487.
Till, B. et al., "CD20-specific adoptive immunotherapy for lymphoma using a chimeric antigen receptor with both CD28 and 4-1BB domains: pilot clinical trial results". Blood (2012); 119(17):3940-3950.
Varadamsetty, G, et al., "Designed Armadillo repeat proteins: library generation, characterization and selection of peptide binders with high specificity", J. Mol. Biol. (2012); 424(1-2): 68-87.
Vincke, C. et al., "General strategy to humanize a camelid single-domain antibody and identification of a universal humanized nanobody scaffold", J Biol Chem. (2009); 284(5):3273-3284.
Vita, C. et al., "Scorpion toxins as natural scaffolds for protein engineering", Proc Natl Acad Sci U S A. (1995); 92(14):6404-6408.
Weisel, J. et al., "A model for fibrinogen: domains and sequence", Science (1985); 230(4732): 1388-1391.
White, I. et al., "Comparison of the glycosyl-phosphatidylinositol cleavage/attachment site between mammalian cells and parasitic protozoa", J Cell Sci. (2000); 113 ( Pt 4):721-727.
Wilkie, S. et al., "Dual targeting of ErbB2 and MUC1 in breast cancer using chimeric antigen receptors engineered to provide complementary signaling", J. Clin. Immunol. (2012); 32(5): 1059-1070.
Zelensky and Gready. "The C-type lectin-like domain superfamily", FEBS J. (2005); 272(24):6179-6217.
Banaszynski, L.A., et al., "Characterization of the FKBP⊙Rapamycin⊙FRB Ternary Complex." Journal of the American Chemical Society (2005); 127.13: 4715-4721.
Fegan, Adrian, et al. "Chemically controlled protein assembly: techniques and applications." Chemical Reviews (2010); 110.6: 3315-3336.
Spencer, David M., et al. "Controlling signal transduction with synthetic ligands." Science (1993); 262: 1019-1024.
Extended European Search Report for European Application No. 14832043.5 dated Feb. 10, 2017, 11 pages.

* cited by examiner

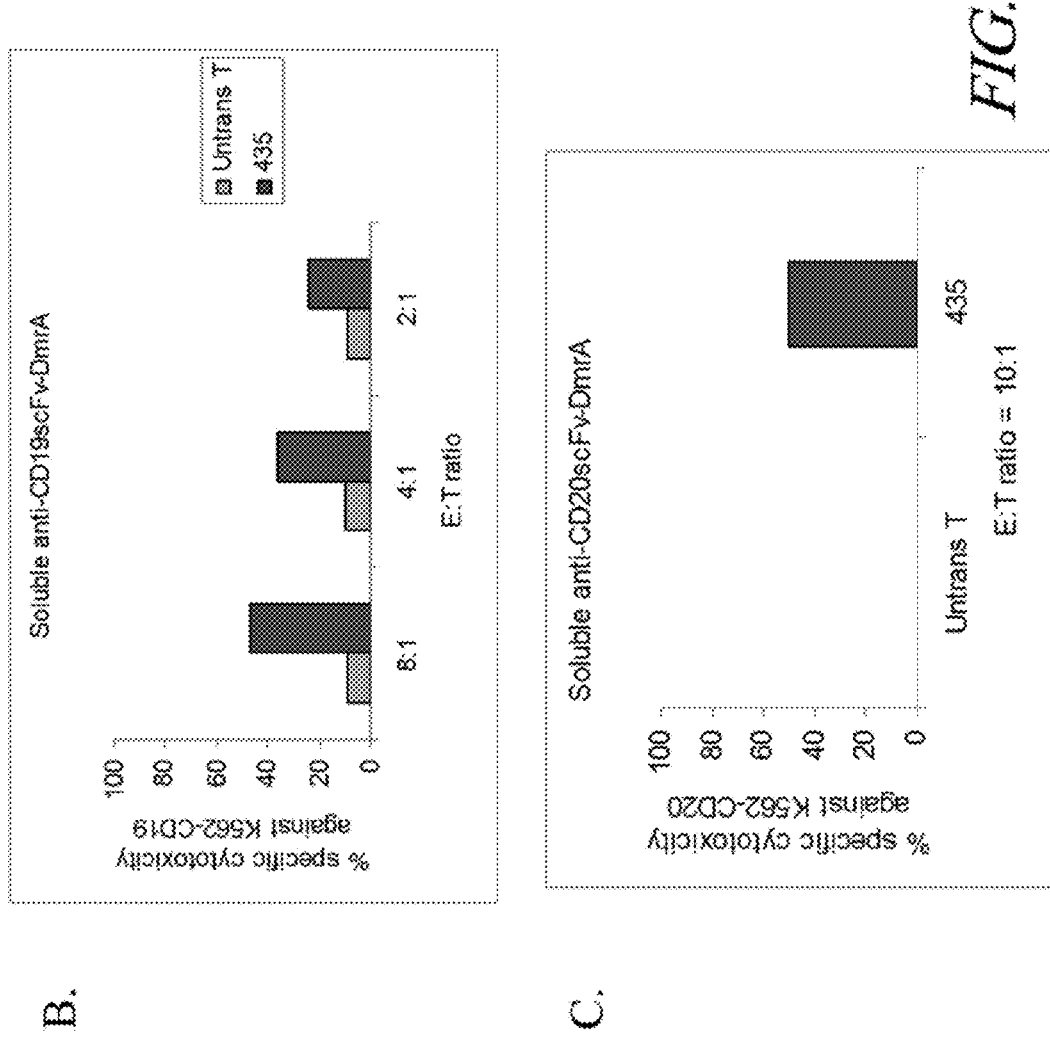
FIG. 13B-C

MULTIPARTITE SIGNALING PROTEINS AND USES THEREOF

CROSS REFERENCE TO RELATED APPLICATIONS

This application is a continuation-in-part of PCT/US2014/047852, filed Jul. 23, 2014, which in turn claims the benefit of U.S. Provisional Application No. 61/934,092, filed Jan. 31, 2014, and U.S. Provisional Application No. 61/859,697, filed Jul. 29, 2013, each of which is incorporated by reference in its entirety.

STATEMENT REGARDING SEQUENCE LISTING

The Sequence Listing associated with this application is provided in text format in lieu of a paper copy, and is hereby incorporated by reference into the specification. The name of the text file containing the Sequence Listing is BLBD_036_03US_ST25.txt. The text file is 634 KB, was created on Jan. 28, 2015, and is being submitted electronically via EFS-Web.

BACKGROUND

Technical Field

The present disclosure relates to compositions and methods for using multi-component proteins in immunotherapy and, more particularly, using chemically induced multimerization to generate chimeric antigen receptor proteins for modulating spatial and temporal control of cellular signal initiation and downstream responses during adoptive immunotherapy.

Description of the Related Art

Cellular therapy is emerging as a powerful paradigm for delivering complex signals for biological action. In contrast to small molecule and biologic drug compositions, cells have the potential to execute unique therapeutic tasks owing to their myriad sensory and response programs and increasingly defined mechanisms of genetic control. To achieve such therapeutic value, cells need to be outfitted with machinery for sensing and integrating chemical and/or biological information associated with local physiological environments.

The most clinically advanced example of engineered sensory-response machinery is chimeric antigen receptors (CARs) in genetically engineered T cells for use in adoptive cellular immunotherapy (see June et al., *Nat. Biotechnol.* 30:611, 2012; Restifo et al., *Nat. Rev. Immunol.* 12:269, 2012). Antigen binding stimulates the signaling domains on the intracellular segment of the CAR, thereby transducing signals that unleash inflammatory and cytotoxicity mechanisms. CAR-based adoptive cellular immunotherapy has been used to treat cancer patients with tumors refractory to conventional standard-of-care treatments (see Grupp et al., *N. Engl. J. Med.* 368:1509, 2013; Kalos et al., *Sci. Transl. Med.* 3:95ra73, 2011).

In addition to targeting and initiating T cell activation, an effective adoptive cellular immunotherapy would preferably also modulate T cell expansion and persistence, as well as the strength and quality of T cell signaling. But, current CAR-mediated T cell responses do not realize the full potential of T cell activation and proliferation. Improvement of CAR function has been achieved by including costimulatory signaling domains into the CAR structure (see, e.g., Kowolik et al., *Cancer Res.* 66:10995, 2006; Milone et al., *Mol. Ther.* 17:1453, 2009; Pule et al., *Mol. Ther.* 12:933, 2005; Carpenito et al., *Proc. Nat'l Acad. Sci. U.S.A.* 106:3360, 2009), but the clinical results have been mixed (see, e.g., Brentjens et al., *Blood* 118:4817, 2011; Till et al., *Blood* 119:3940, 2012; Kochenderfer and Rosenberg, *Nat. Rev. Clin. Oncol.* 10:267, 2013). Others have included, in addition to a CAR, co-expression of costimulatory ligands (see, e.g., Stephan et al., *Nat. Med.* 13:1440, 2007), costimulatory receptors (see, e.g., Duong et al., *Immunother.* 3:33, 2011; Wilkie et al., *J. Clin. Immunol.* 32:1059, 2012), and cytokines (see, e.g., Hsu et al., *J. Immunol.* 175:7226, 2005; Quintarelli et al., *Blood* 110:2793, 2007).

A concern with the use of CARs is toxicity, which arises in two forms: one is the targeted destruction of normal tissue and the second is cytokine-release associated adverse events (e.g., cytokine storm). For example, collateral damage observed with CD19-targeted CARs is B-cell aplasia (Kalos et al., 2011; Kochenderfer et al., *Blood* 119:2709, 2012). Such off-target effects could be very dangerous, particularly if the target antigen is found on other tissues, such as the heart or lung. The cytokine storms associated with large numbers of activated T cells can be life threatening (Kalos et al., 2011; Kochenderfer et al., 2012). Unlike conventional drug treatments where reducing drug dosage can control toxicity, the proliferation of T cells cannot be controlled with current CAR technologies and, therefore, immunopathology will result once a threshold level of T cells is reached.

In view of the limitations associated with CAR-mediated T cell responses, there is a need in the art for alternative compositions and methods useful for immunotherapy in which modulation of immune cell signal initiation and expansion is controllable. The present disclosure meets such needs, and further provides other related advantages.

SUMMARY OF THE INVENTION

The present disclosure describes improved chimeric antigen receptor signaling complexes and non-natural cell compositions having signal transduction systems that are controlled—both in their activation and deactivation—by pharmacological agents. Numerous pharmacologically controlled, multipartite signal transduction systems are contemplated herein.

In various embodiments, the present invention contemplates, in part, a non-natural cell, comprising: a first nucleic acid molecule encoding a first fusion protein comprising a first multimerization domain, a first hydrophobic domain, and an actuator domain, wherein the first multimerization domain localizes extracellularly when the first fusion protein is expressed; and a second nucleic acid molecule encoding a second fusion protein comprising a binding domain and a second multimerization domain, and a second hydrophobic domain; wherein a first bridging factor promotes the formation of a polypeptide complex on the non-natural cell surface with the bridging factor associated with and disposed between the multimerization domains of the first and second fusion proteins.

In particular embodiments, the first and second multimerization domains are the same or different.

In additional embodiments, the multimerization domains of the first and second fusion proteins associate with a bridging factor selected from rapamycin or a rapalog thereof, coumermycin or a derivative thereof, gibberellin or a derivative thereof, abscisic acid (ABA) or a derivative thereof, methotrexate or a derivative thereof, cyclosporin A or a derivative thereof, FKCsA or a derivative thereof, trimethoprim (Tmp)-synthetic ligand for FKBP (SLF) or a derivative thereof, or any combination thereof.

In certain embodiments, the first and second multimerization domains are a pair selected from FKBP and FRB, FKBP and calcineurin, FKBP and cyclophilin, FKBP and bacterial DHFR, calcineurin and cyclophilin, PYL1 and ABI1, or GIB1 and GAI, or variants thereof.

In certain embodiments, the first multimerization domain comprises a first FKBP polypeptide or variant thereof, and the second multimerization domain comprises a first FRB polypeptide or variant thereof.

In further embodiments, the first multimerization domain comprises a first FRB polypeptide or variant thereof, and the second multimerization domain comprises a first FKBP polypeptide or variant thereof.

In some embodiments, the bridging factor is sirolimus, everolimus, novolimus, pimecrolimus, ridaforolimus, tacrolimus, temsirolimus, umirolimus, or zotarolimus.

In additional embodiments, the first fusion protein has at least one multimerization domain of FKBP, DHFR or GyrB.

In particular embodiments, the binding domain of the polypeptide complex specifically binds to a target located on a target cell surface.

In particular embodiments, the first hydrophobic domain is a transmembrane domain selected from the group of a CD4, CD8, AMN, or CD28 transmembrane domain.

In some embodiments, the second hydrophobic domain comprises a CD154 transmembrane domain.

In certain embodiments, the second hydrophobic domain comprises a CD71 transmembrane domain.

In particular embodiments, a particular transmembrane domain may be included in the first or second fusion proteins as a type I or type II transmembrane domain.

In further embodiments, the first hydrophobic domain and the second hydrophobic domain do not increase cytotoxic activity of the non-natural cell in the absence of the bridging factor.

In additional embodiments, the first hydrophobic domain and the second hydrophobic domain increase cytotoxic activity of the non-natural cell in the absence of the bridging factor, wherein the increase in cytotoxic activity is less than the cytotoxic activity in the presence of the bridging factor.

In certain embodiments, the actuator domain comprises a lymphocyte receptor signaling domain.

In additional embodiments, the actuator domain comprises one or a plurality of immunoreceptor tyrosine-based activation motifs (ITAMs).

In some embodiments, the actuator domain comprises CD3ε, CD3δ, CD3ζ, pTα, TCRα, TCRβ, FcRα, FcRβ, FcRγ, NKG2D, CD22, CD79A, or CD79B, or any combination thereof.

In particular embodiments, the first nucleic acid molecule encodes the first fusion protein further comprising a different actuator domain, a costimulatory domain, an adhesion factor, or any combination thereof.

In further embodiments, the costimulatory domain is selected from CD27, CD28, CD30, CD40, LAT, Zap70, ICOS, DAP10, 4-1BB, CARD11, HVEM, LAG3, SLAMF1, Lck, Fyn, Slp76, TRIM, OX40, or any combination thereof.

In additional embodiments, the actuator domain comprises a cytoplasmic portion that associates with a cytoplasmic signaling protein.

In some embodiments, the cytoplasmic signaling protein is a lymphocyte receptor or signaling domain thereof, a protein comprising a plurality of immunoreceptor tyrosine-based activation motifs (ITAMs), a costimulatory domain, an adhesion factor, or any combination thereof.

In particular embodiments, the lymphocyte receptor or signaling domain thereof is CD3ε, CD3δ, CD3ζ, pTα, TCRα, TCRβ, FcRα, FcRβ, FcRγ, NKG2D, CD22, CD79A, or CD79B, or any combination thereof.

In particular embodiments, the costimulatory domain is selected from CD27, CD28, CD30, CD40, LAT, Zap70, ICOS, DAP10, 4-1BB, CARD11, HVEM, LAG3, SLAMF1, Lck, Fyn, Slp76, TRIM, OX40, or any combination thereof.

In further embodiments, the non-natural cell further overexpresses a costimulatory factor, an immunomodulatory factor, an agonist for a costimulatory factor, an agonist for an immunomodulatory factor, or any combination thereof.

In certain embodiments, the second nucleic acid molecule further encodes a secretion signal such that the second fusion protein is secreted from the non-natural cell when expressed, and optionally further encodes an anchor domain.

In additional embodiments, the binding domain of the second fusion protein is a single chain antibody variable region, a receptor ectodomain, or a ligand.

In particular embodiments, the single chain antibody variable region is a domain antibody, sFv, scFv, F(ab')$_2$, or Fab.

In some embodiments, the binding domain of the second fusion protein is amino terminal to the multimerization domain.

In additional embodiments, the binding domain of the second fusion protein is carboxy terminal to the multimerization domain.

In further embodiments, the second nucleic acid molecule encoding the second fusion protein further comprises a sequence encoding a linker disposed between the binding domain and the second multimerization domain.

In particular embodiments, the fusion proteins comprising a binding domain have one, two, three, or four binding domains.

In certain embodiments, the one, two, three, or four binding domains are specific for one target or up to four different targets.

In certain embodiments, the binding domain is specific for a target that is an antigen associated with a cancer, an inflammatory disease, an autoimmune disease, or a graft versus host disease.

In additional embodiments, the cancer is a solid malignancy or a hematologic malignancy.

In particular embodiments, the hematologic malignancy associated antigen target is CD19, CD20, CD22, CD33, or CD37.

In some embodiments, the binding domain specifically binds to a target selected from α-folate receptor, $α_vβ_6$ integrin, BCMA, B7-H3, B7-H6, CAIX, CD19, CD20, CD22, CD30, CD33, CD37, CD44, CD44v6, CD44v7/8, CD70, CD123, CD138, CD171, CEA, DLL4, EGP-2, EGP-40, CSPG4, EGFR, EGFR family including ErbB2 (HER2), EGFRvIII, EPCAM, EphA2, EpCAM, FAP, FBP, fetal acetylcholine receptor, Fzd7, GD2, GD3, Glypican-3 (GPC3), h5T4, IL-11Rα, IL13R-α2, KDR, κ light chain, λ light chain, LeY, L1CAM, MAGE-A1, mesothelin, MHC presented peptides, MUC1, MUC16, NCAM, NKG2D ligands, Notch1, Notch2/3, NY-ESO-1, PRAME, PSCA, PSMA, Survivin, TAG-72, TEMs, TERT, VEGFR2, and ROR1.

In further embodiments, the encoded first fusion protein comprises a first multimerization domain of FRB T2098L, a transmembrane domain, a costimulatory domain of 4-1BB, and actuator domain of CD3ζ; wherein the second encoded fusion protein comprises a binding domain of an scFv specific for CD19 and a second multimerization domain of FKBP12 and a CD154 or a CD71 transmembrane domain;

and wherein the first bridging factor that promotes the formation of a polypeptide complex on the non-natural cell surface is rapalog AP21967.

In particular embodiments, the encoded first fusion protein comprises a first multimerization domain of FRB, a transmembrane domain, a costimulatory domain of 4-1BB, and actuator domain of CD3ζ; wherein the second encoded fusion protein comprises a binding domain of an scFv specific for CD19 and a second multimerization domain of FKBP12 and a CD154 or a CD71 transmembrane domain; and wherein the first bridging factor that promotes the formation of a polypeptide complex on the non-natural cell surface is Rapamycin, temsirolimus or everolimus.

In various embodiments, the present invention contemplates, in part, a method for treating a hyperproliferative, inflammatory, autoimmune, or graft-versus-host disease, comprising: administering a non-natural cell according to any one of embodiments contemplated herein; and administering a bridging factor, wherein the bridging factor promotes the formation of a polypeptide complex on the recombinant cell surface with the bridging factor associated with and disposed between the multimerization domains of the first and second fusion proteins; wherein the binding domain of the polypeptide complex specifically binds a cell surface target on a hyperproliferative, inflammatory, autoimmune, or graft-versus-host disease cell to promote an immunomodulatory response and thereby treats the hyperproliferative, inflammatory, autoimmune, or graft-versus-host disease.

In certain embodiments, the method further comprises administering an agent that antagonizes or blocks an inhibitor of T-cell activation.

In additional embodiments, the agent antagonizes or blocks a T-cell ligand.

In particular embodiments, the agent antagonizes or blocks a T-cell receptor.

In particular embodiments, the agent that antagonizes or blocks an inhibitor of T-cell activation is an anti-PD1 antibody or antigen binding fragment thereof, anti-PD-L1 antibody or antigen binding fragment thereof, or an anti-CTLA4 antibody or antigen binding fragment thereof or an engineered homing endonuclease that targets PD-1.

In some embodiments, the method further comprises administering a cytokine agonist.

In various embodiments, the present invention contemplates, in part, a fusion polypeptide heterocomplex, comprising: a first fusion protein comprising a first multimerization domain, a first hydrophobic domain, and an actuator domain; a second fusion protein comprising an extracellular binding domain, a second multimerization domain, and a second hydrophobic domain; and a bridging factor; wherein the first fusion protein, second fusion protein, and bridging factor associate to form a polypeptide heterocomplex with the bridging factor associated with and disposed between the multimerization domains of the first and second fusion proteins.

In further embodiments, the binding domain is a single chain antibody variable region, a receptor ectodomain, or a ligand.

In certain embodiments, the single chain antibody variable region is a domain antibody, sFv, scFv, F(ab')$_2$, or Fab.

In certain embodiments, the binding domain is amino terminal to the multimerization domain.

In some embodiments, the binding domain is carboxy terminal to the multimerization domain.

In particular embodiments, the first multimerization domain comprises a first FKBP polypeptide or variant thereof, and the second multimerization domain comprises a first FRB polypeptide or variant thereof.

In additional embodiments, the first multimerization domain comprises a first FRB polypeptide or variant thereof, and the second multimerization domain comprises a first FKBP polypeptide or variant thereof.

In particular embodiments, the first hydrophobic domain is a transmembrane domain.

In some embodiments, the second hydrophobic domain comprises a CD154 transmembrane domain.

In certain embodiments, the second hydrophobic domain comprises a CD71 transmembrane domain.

In particular embodiments, the first hydrophobic domain and the second hydrophobic domain do not increase cytotoxic activity of the non-natural cell in the absence of the bridging factor.

In further embodiments, the first hydrophobic domain and the second hydrophobic domain increase cytotoxic activity of the non-natural cell in the absence of the bridging factor, wherein the increase in cytotoxic activity is less than the cytotoxic activity in the presence of the bridging factor.

In certain embodiments, the actuator domain comprises a lymphocyte receptor chain.

In particular embodiments, the bridging factor is rapamycin or a rapalog thereof, coumermycin or a derivative thereof, gibberellin or a derivative thereof, ABA or a derivative thereof, methotrexate or a derivative thereof, cyclosporin A or a derivative thereof, FKCsA or a derivative thereof, or Tmp-SLF or a derivative thereof.

In additional embodiments, the second fusion protein further comprises a sub-threshold signaling domain.

In some embodiments, the binding domain is specific for a target that is an antigen associated with a cancer, an inflammatory disease, an autoimmune disease, or a graft versus host disease.

In particular embodiments, the cancer is a hematologic malignancy having an antigen target of CD19, CD20, CD22, CD33, or CD37.

In various embodiments, the present invention contemplates, in part, a nucleic acid molecule encoding any one or more of the fusion proteins contemplated herein.

In certain embodiments, the nucleic acid molecule is disposed between 5' and 3' polynucleotide sequences homologous to a genomic locus.

In various embodiments, the present invention contemplates, in part, an expression vector containing a nucleic acid encoding any one or more of the fusion proteins contemplated herein.

In further embodiments, the first and second fusion proteins are encoded as a polycistronic message or as a single protein separated by a 2A peptide.

In additional embodiments, the polycistronic message comprises an internal ribosome entry site (IRES) between the nucleotide sequences that encode the fusion proteins.

In particular embodiments, the first protein is expressed from a first promoter and the second fusion protein is expressed from a second promoter.

In some embodiments, the first promoter is selected from the group consisting of: a CMV promoter, an EF1α promoter, and an MND promoter.

In particular embodiments, the second promoter is selected from the group consisting of: a CMV promoter, an EF1α promoter, and an MND promoter.

In further embodiments, the first promoter and the second promoter are not the same promoter.

BRIEF DESCRIPTION THE DRAWINGS

Figure 5:
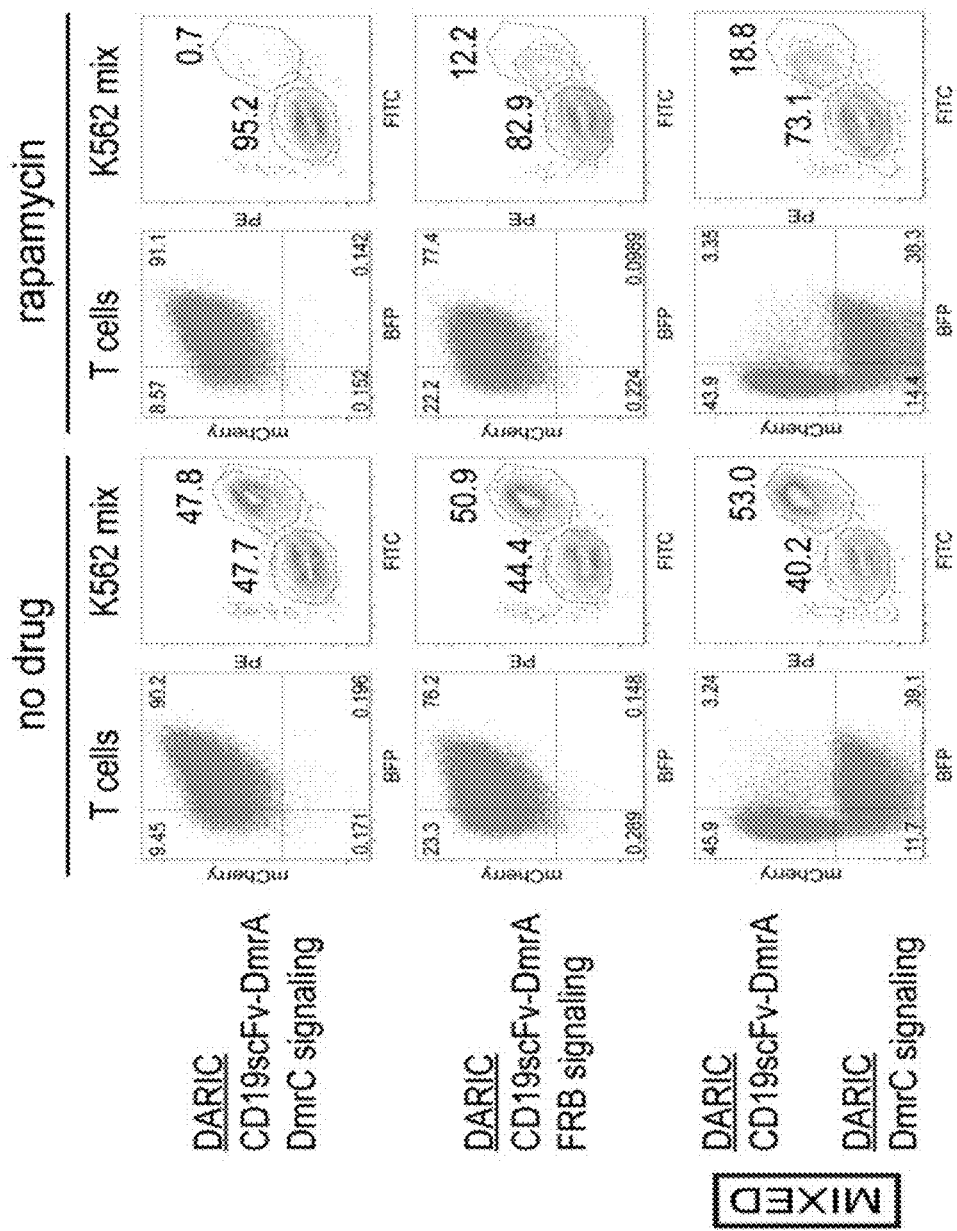
Figure 5:
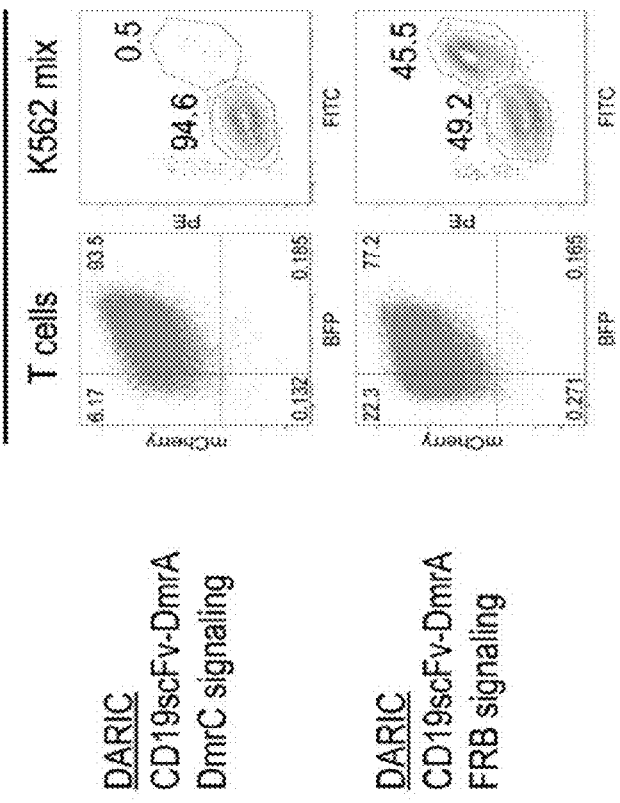

FIG. 5 shows that use of independent multimerization domains having different specificities for bridging components allows for directed cytotoxic activity of human T cells expressing a multipartite signaling complex of this disclosure. In addition, this figure shows that human T cells expressing a multipartite signaling complex of this disclosure can be cytotoxic even when the DARIC binding and signaling components are individually expressed in separate cells.

Figure 6:
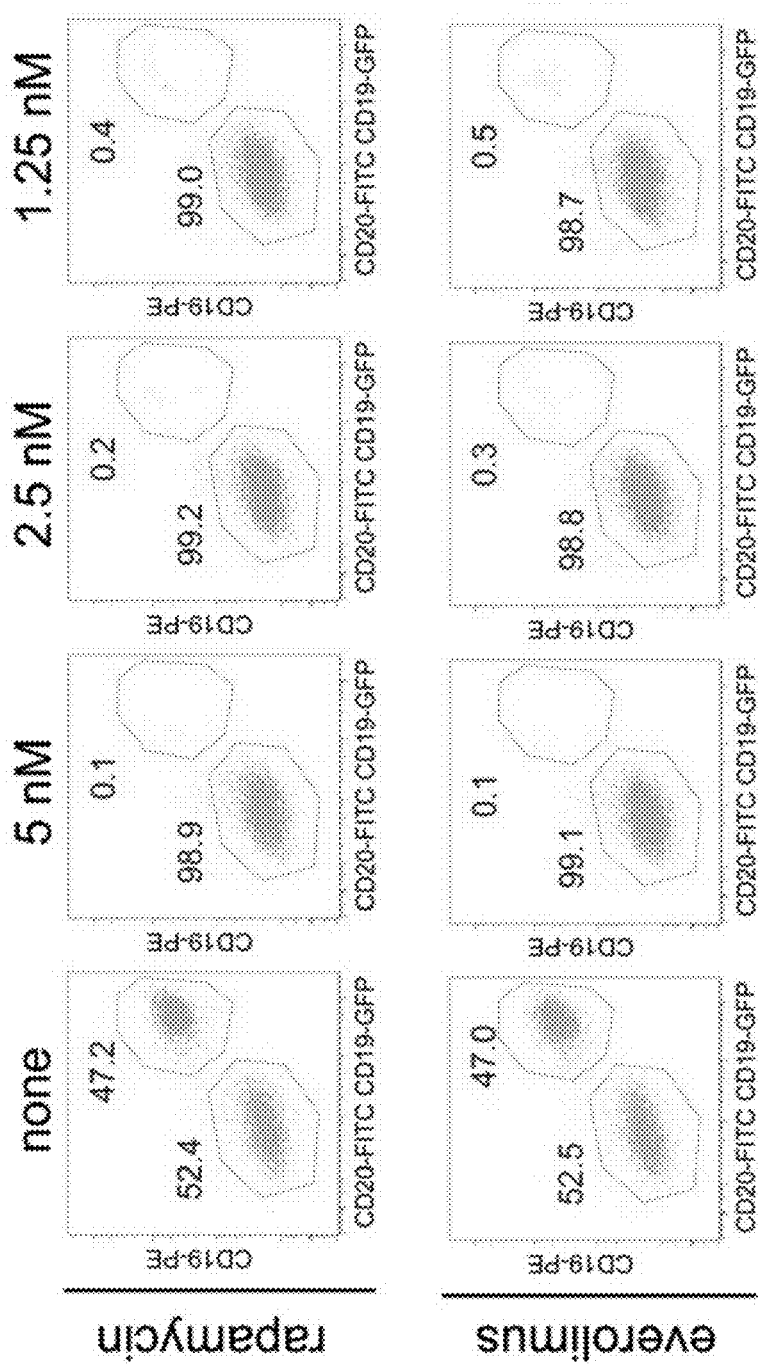
Figure 6:
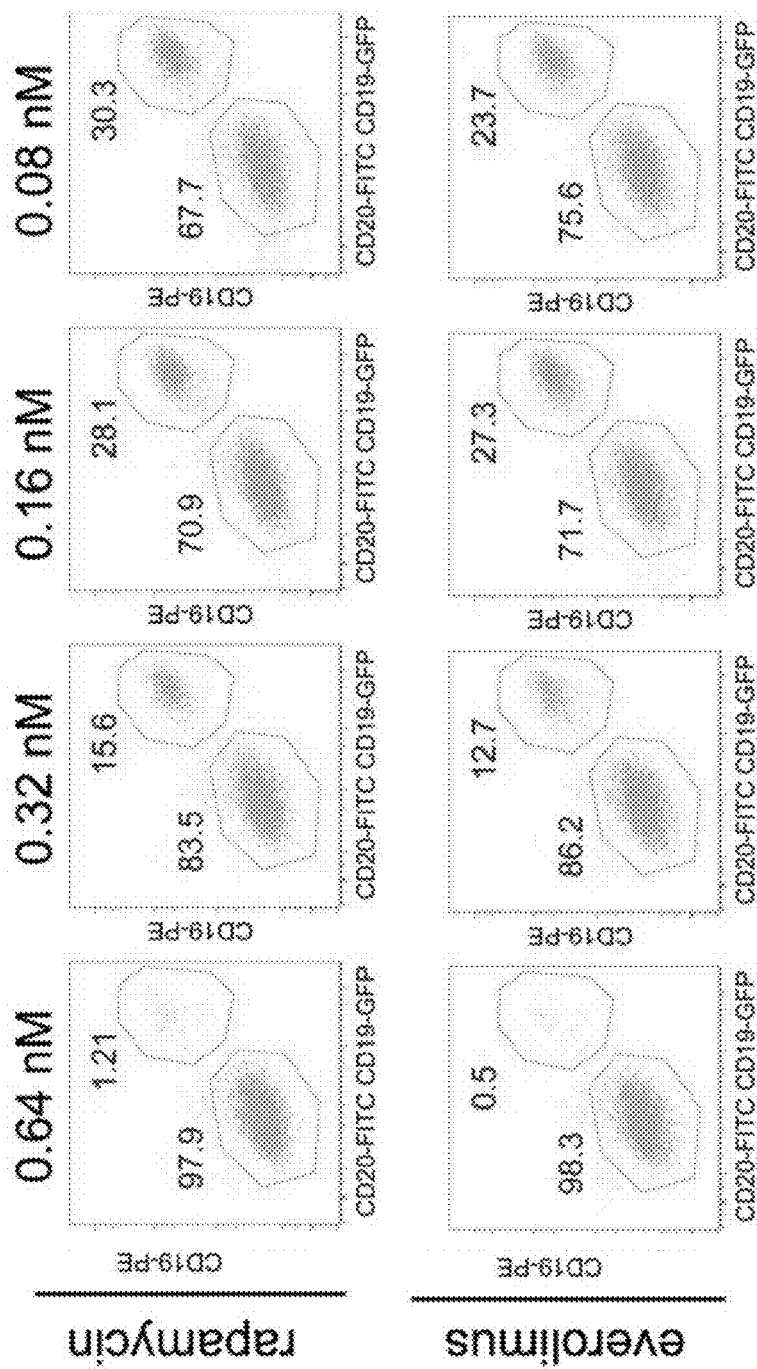

FIG. 6 shows that bridging factors can function in the DARIC system at clinically relevant concentrations.

Figure 7:
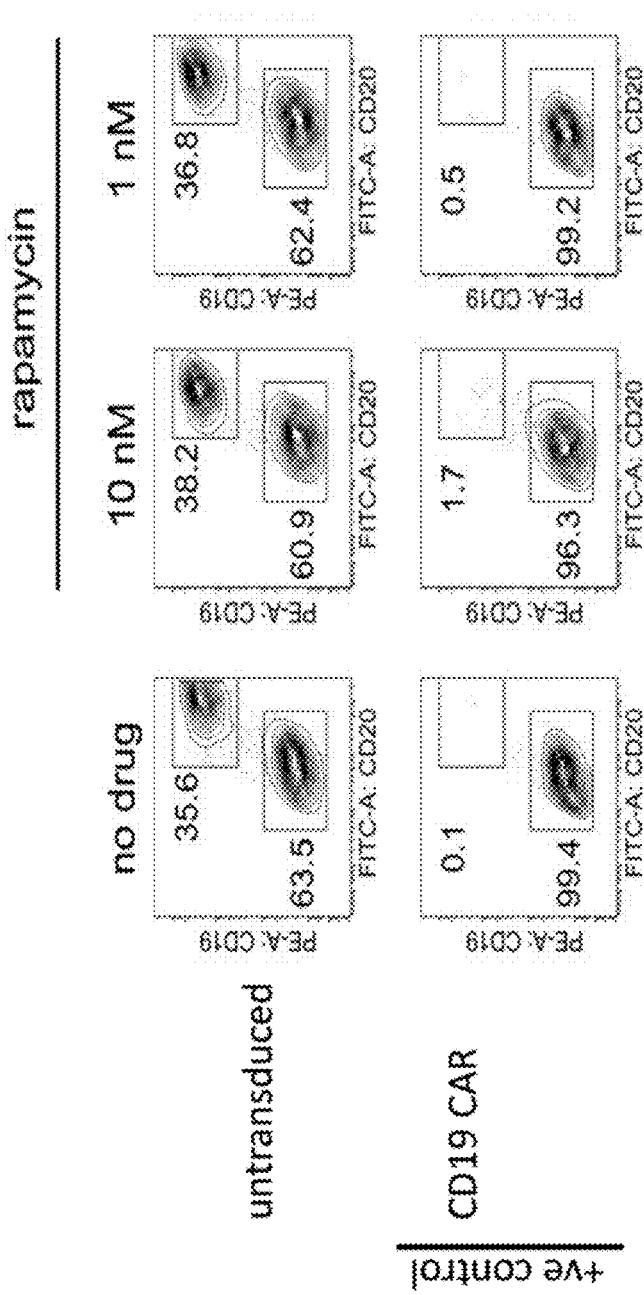
Figure 7:
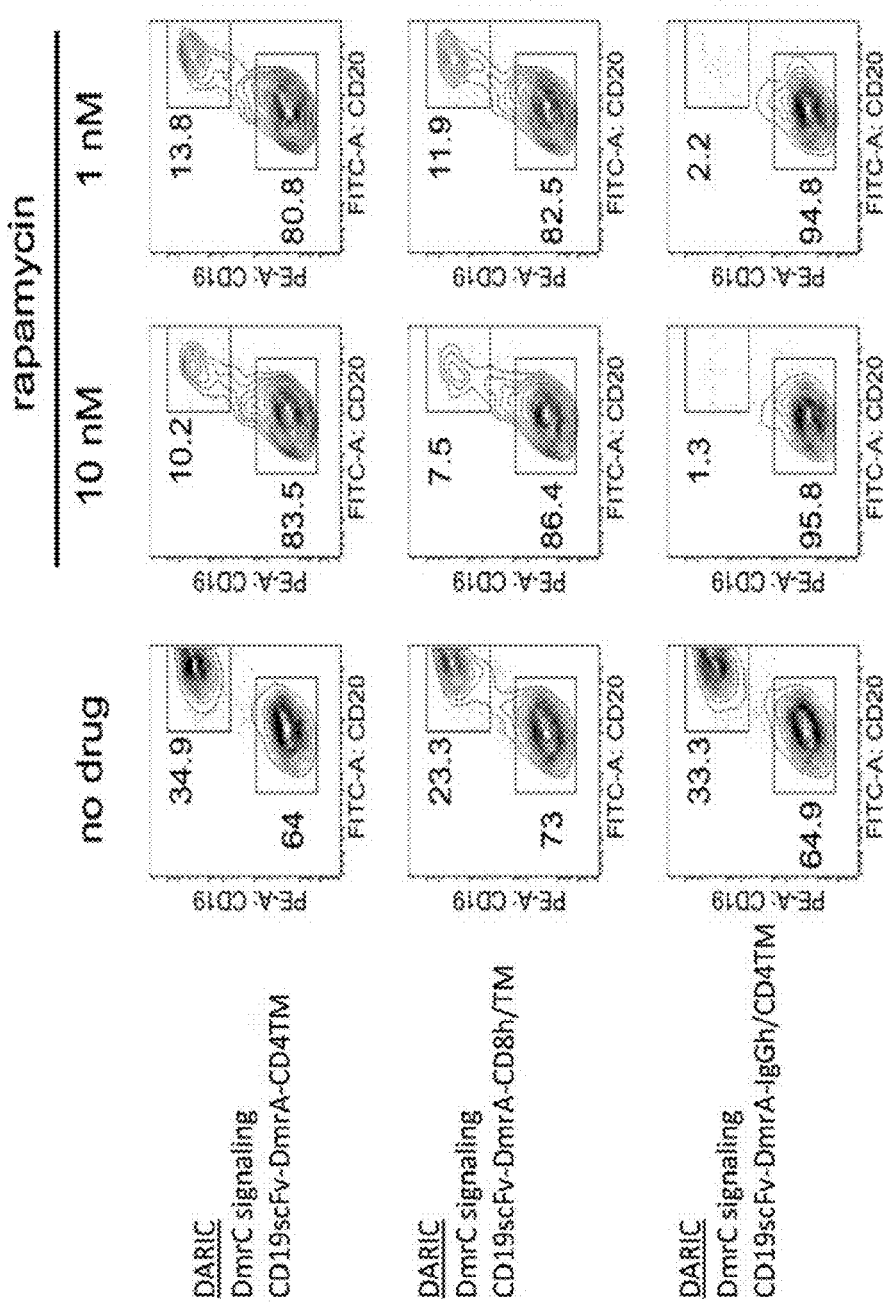

FIG. 7 shows that a DARIC binding component can be released from a cell or tethered to the cell surface and still functionally associate with a DARIC signaling component to form a multipartite signaling complex of this disclosure.

Figure 8:
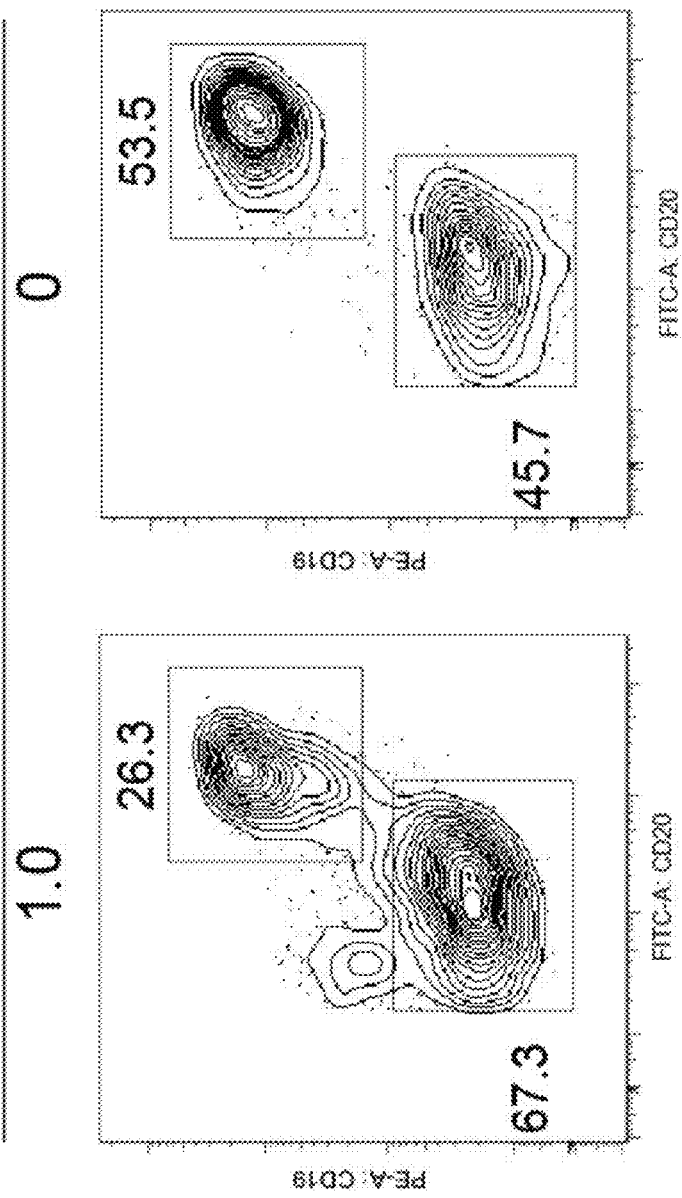

FIG. 8 shows that a DARIC binding component may be tethered to the cell surface via GPI-anchor and still functionally associate with a DARIC signaling component in the presence of a bridging factor to form a multipartite signaling complex of this disclosure.

Figure 9:
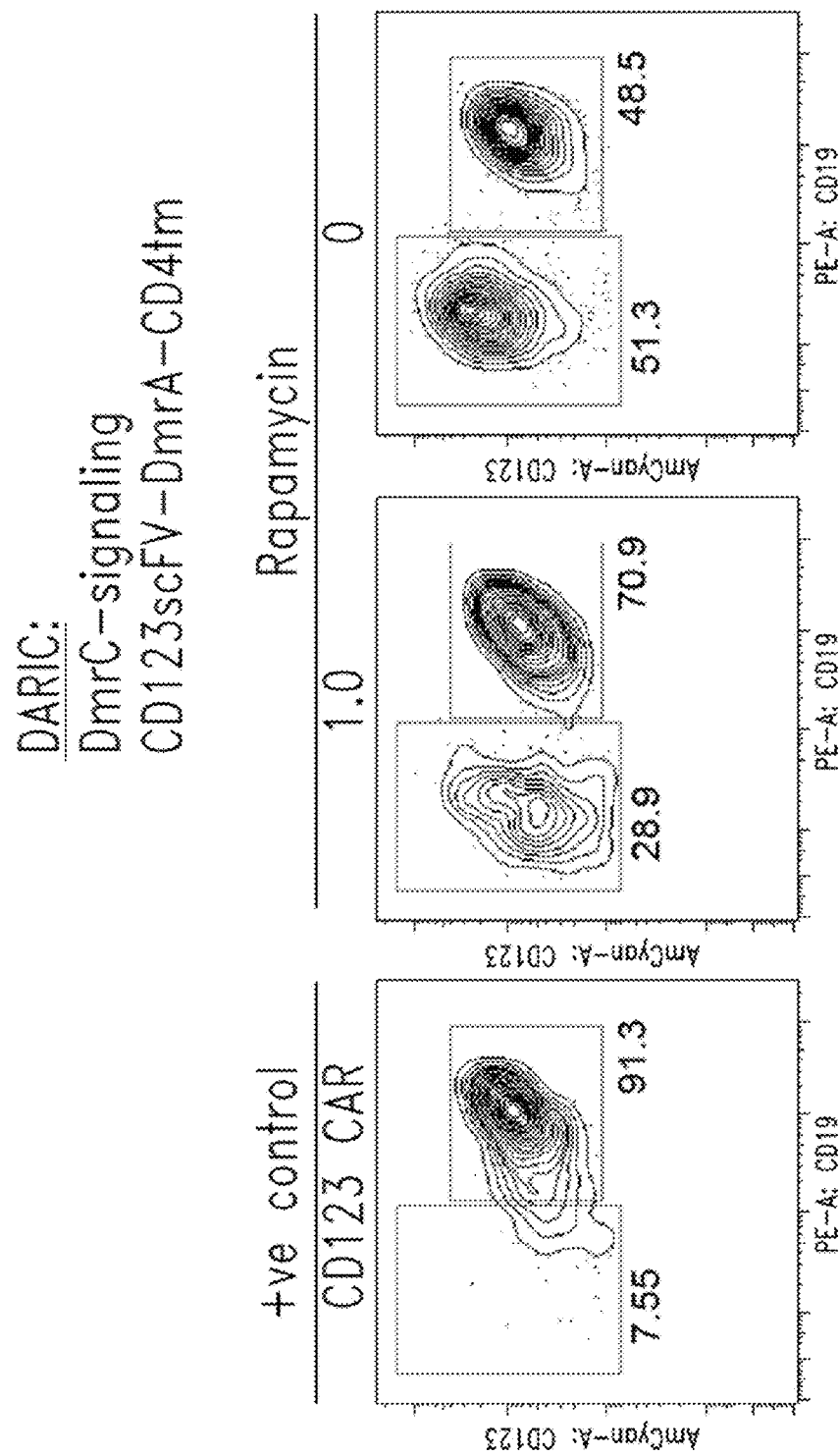

FIG. 9 shows a DARIC system targeting an additional model antigen, CD123, that may be used either to eradicate a myeloid cancer, or in a conditioning regimen to ablate myeloid cells prior to a bone marrow transplant.

Figure 10:
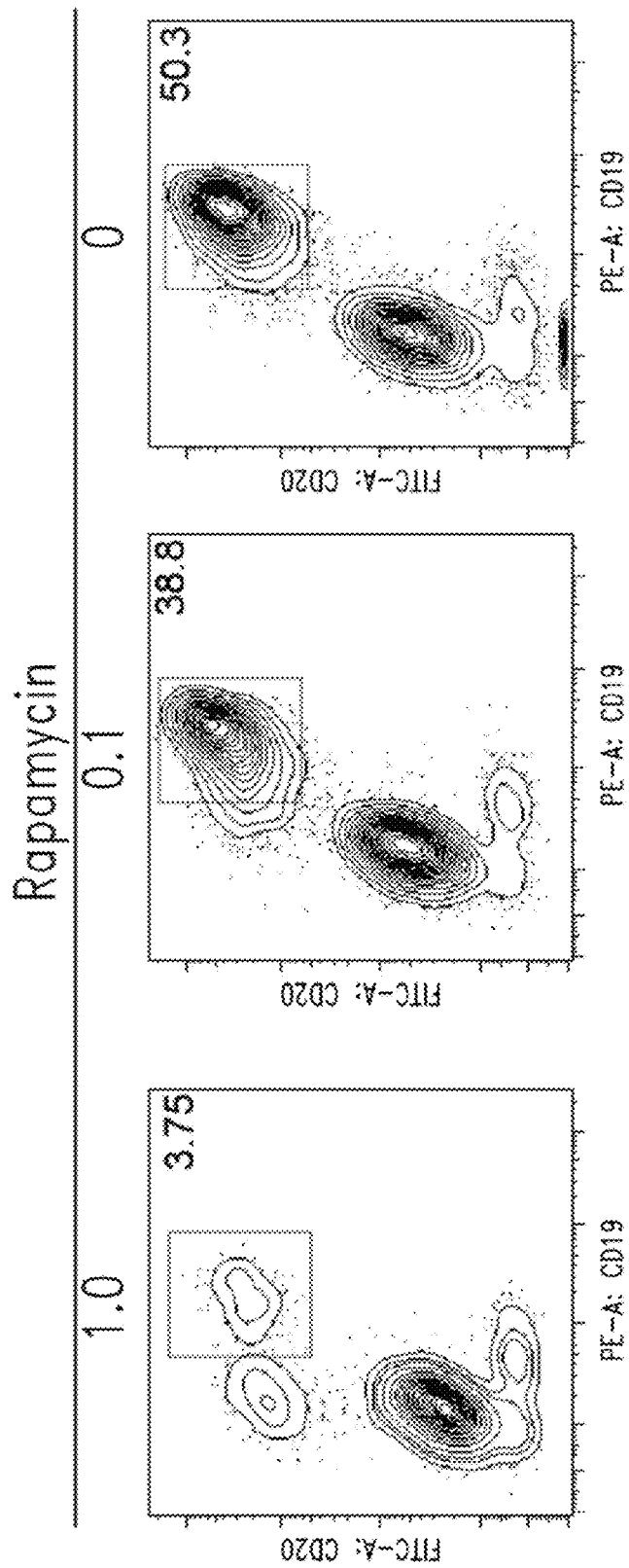

FIG. 10 shows that the FRB and FKBP12 multimerization domains may be appended to the DARIC binding component or signaling component and still form a functional multipartite signaling complex in the presence of a bridging factor.

Figure 11:
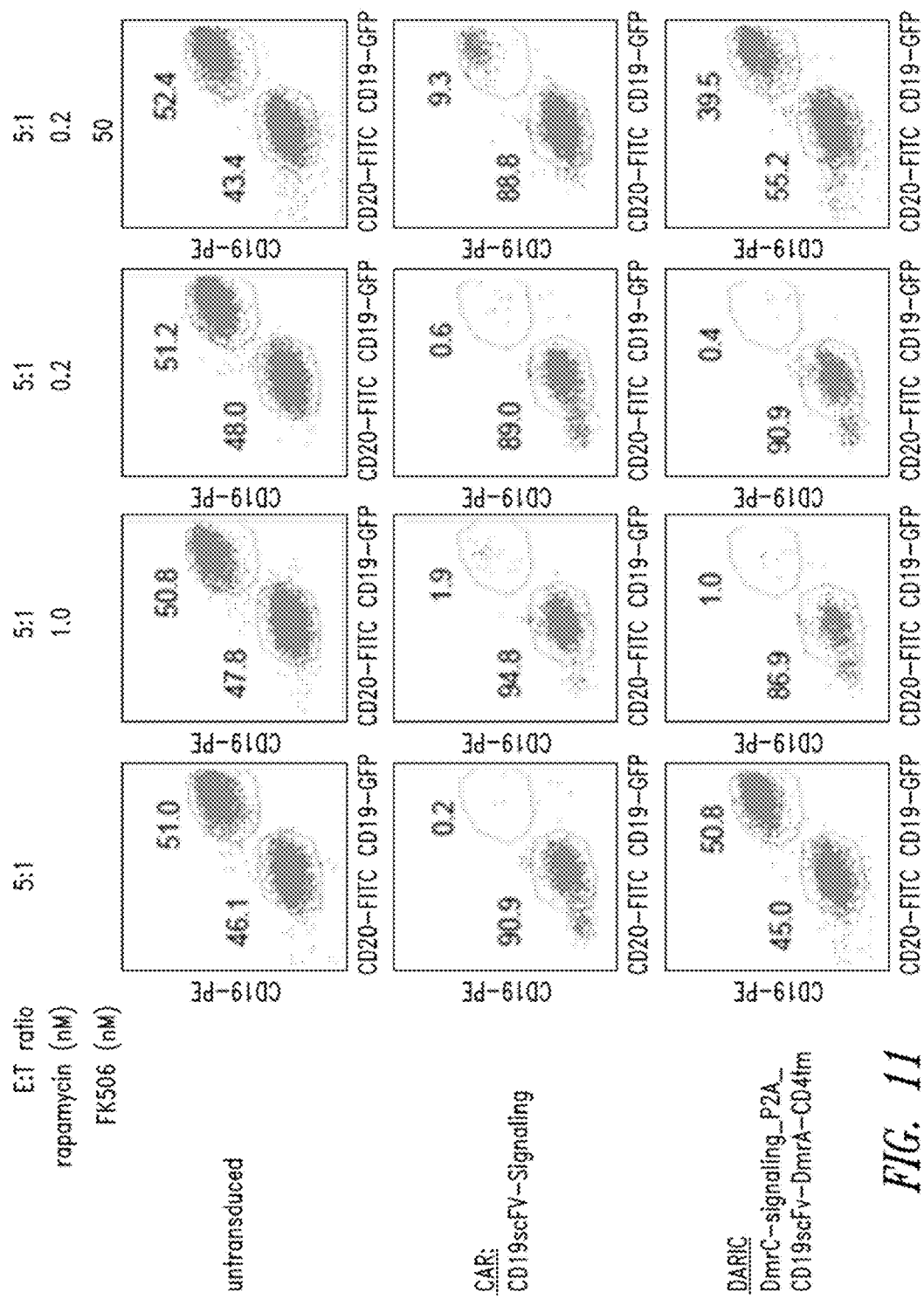

FIG. 11 shows that the coupling of the DARIC binding and signaling components can be deactivated by the addition of an anti-bridging factor, a monovalent drug that binds only to one of the multimerization domains and thereby blocks the activation of the cell.

Figure 12:
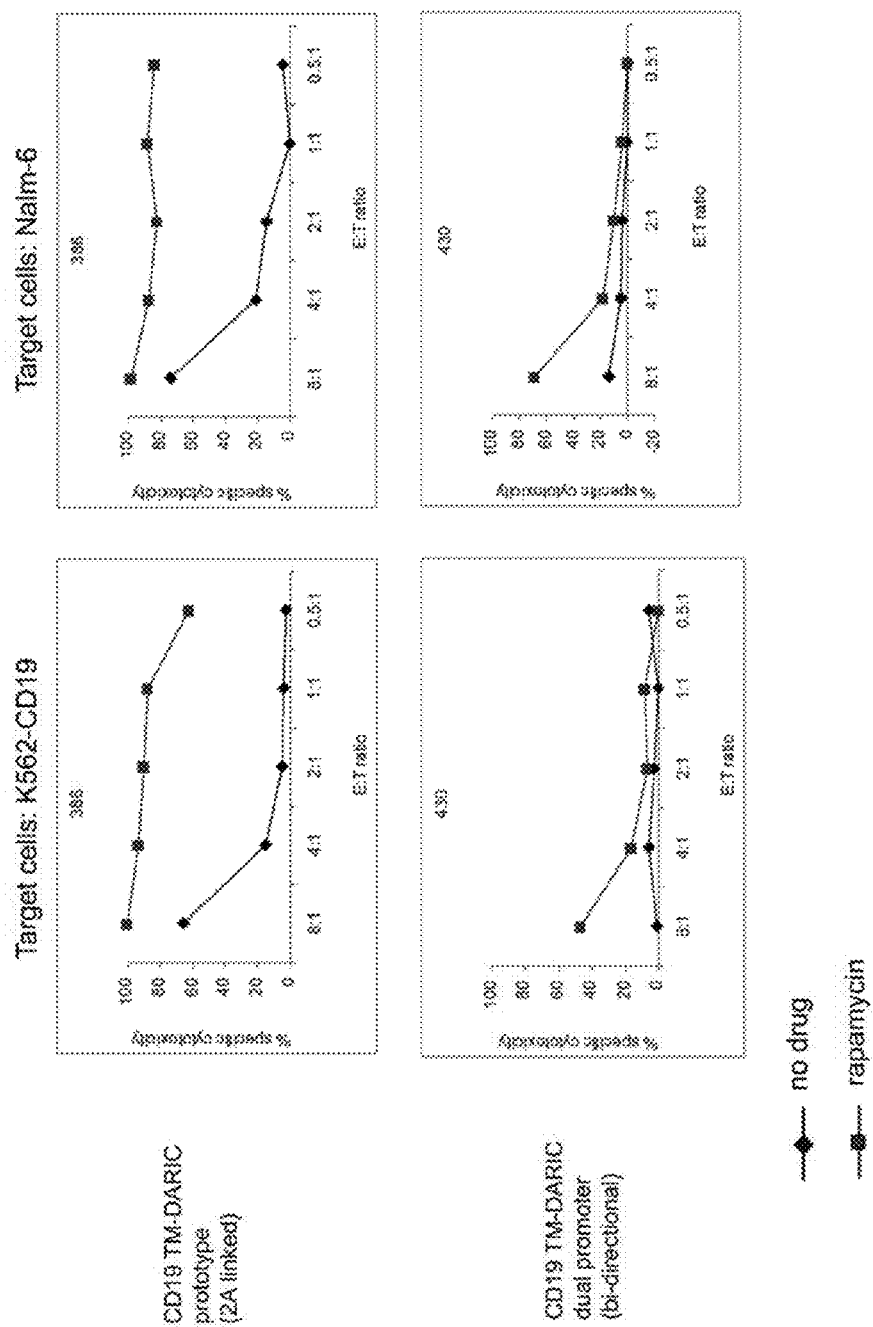

FIG. 12 shows that T cells harboring a dual vector promoter that expresses both the DARIC binding component and the DARIC signaling component mediates a target cell specific cytotoxic response.

Figure 13A:
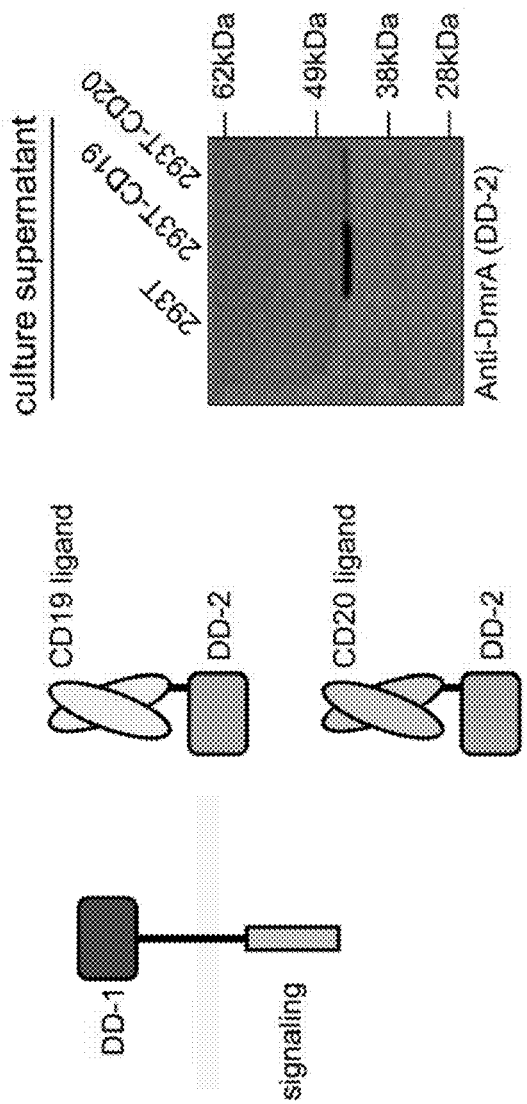

FIGS. 13A-C show that T cells expressing a DARIC signaling component can mediate antigen specific cytotoxicity when a soluble DARIC binding component that recognizes the target cell is provided in trans, e.g., secreted into the culture medium or extracellular milieu as a model for delivery of the DARIC binding component as a separate biologic drug.

Figure 14A:
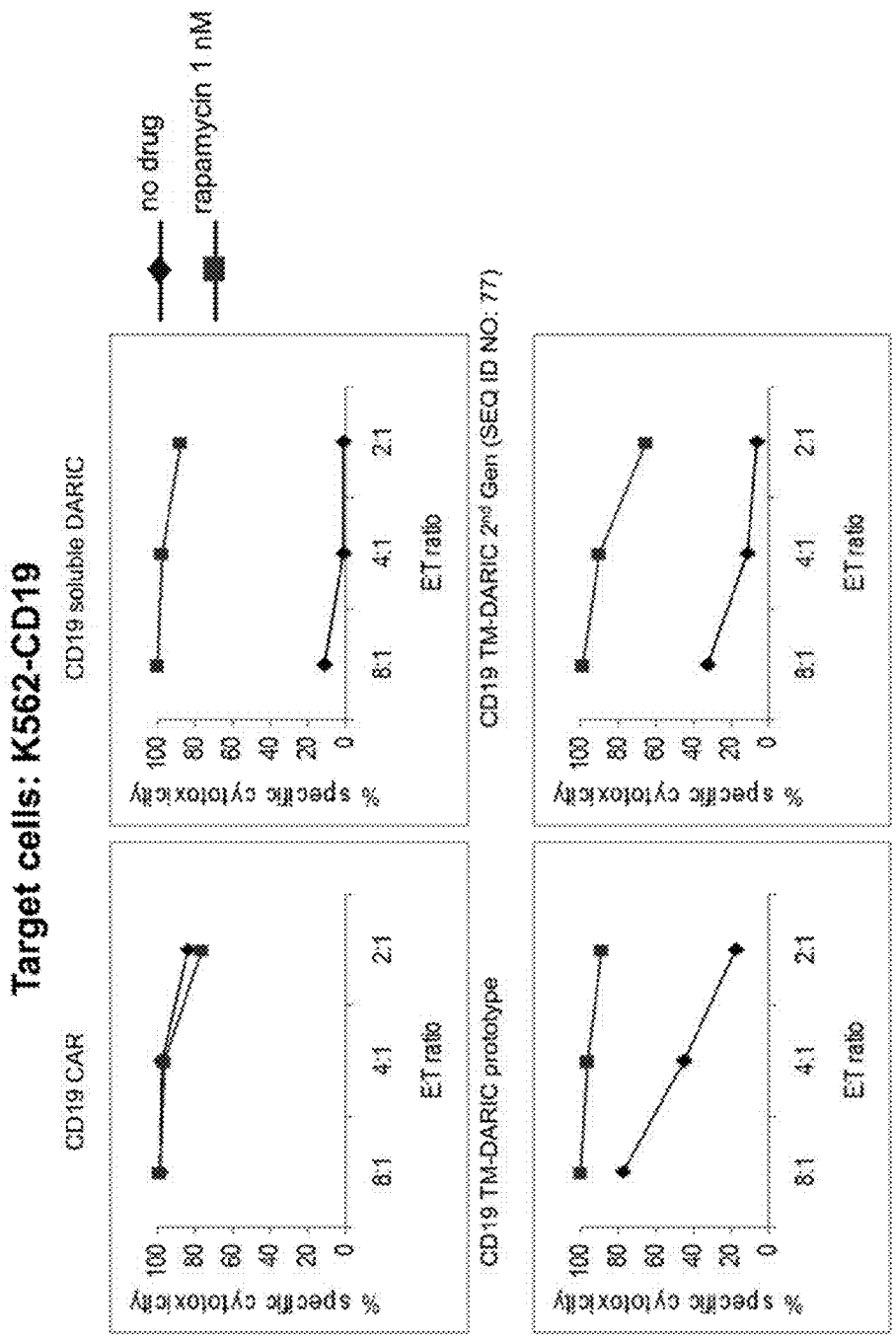
Figure 14B:
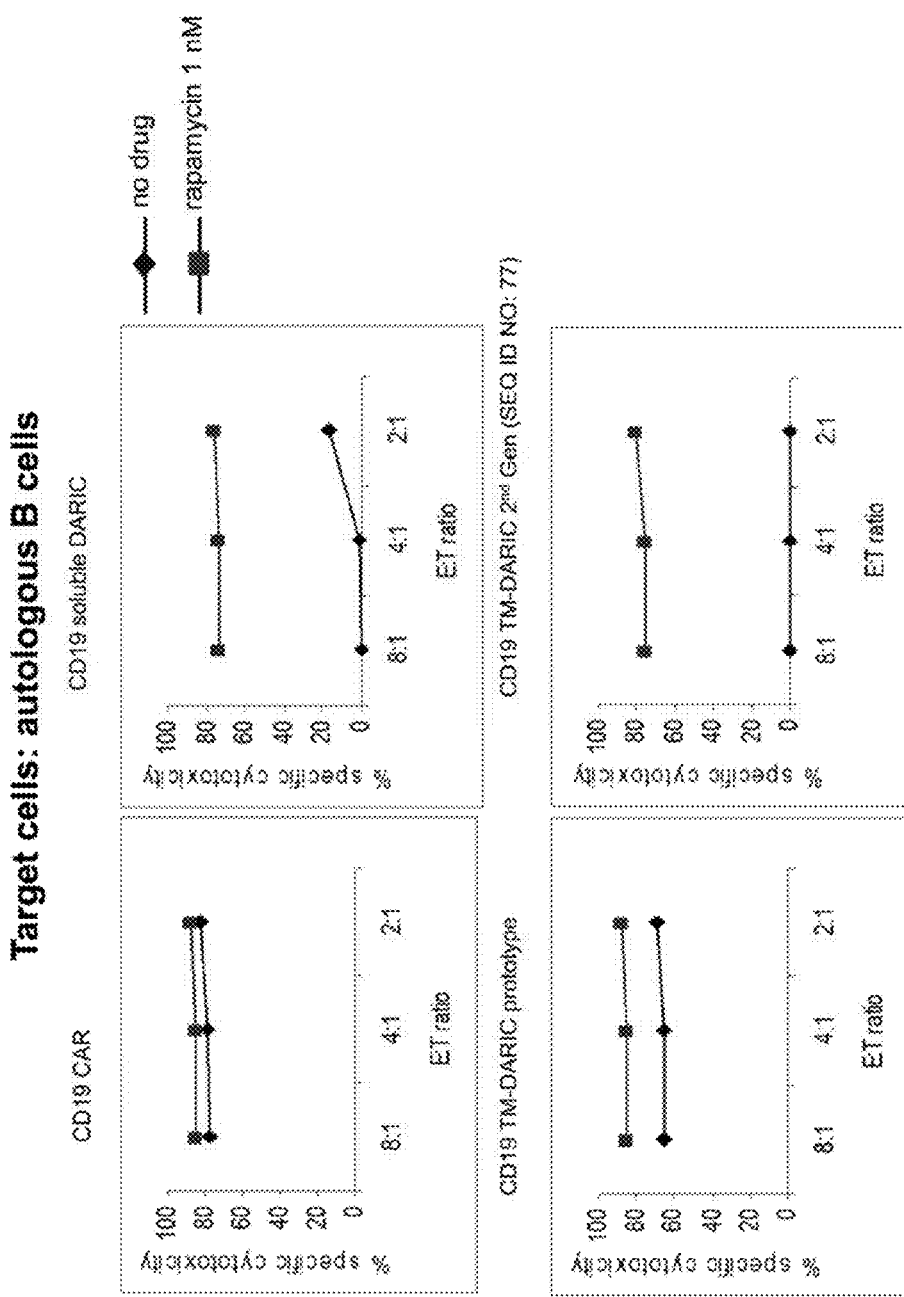

FIGS. 14A-B shows that a prototypical transmembrane DARIC binding component harboring a CD4 transmembrane domain has residual signaling activity in the absence of a bridging factor against autologous B cells. The residual signaling activity is reduced or eliminated when the CD4 transmembrane domain is replaced with another transmembrane domain, e.g., a CD71 or CD154 transmembrane domain.

Figure 15A:
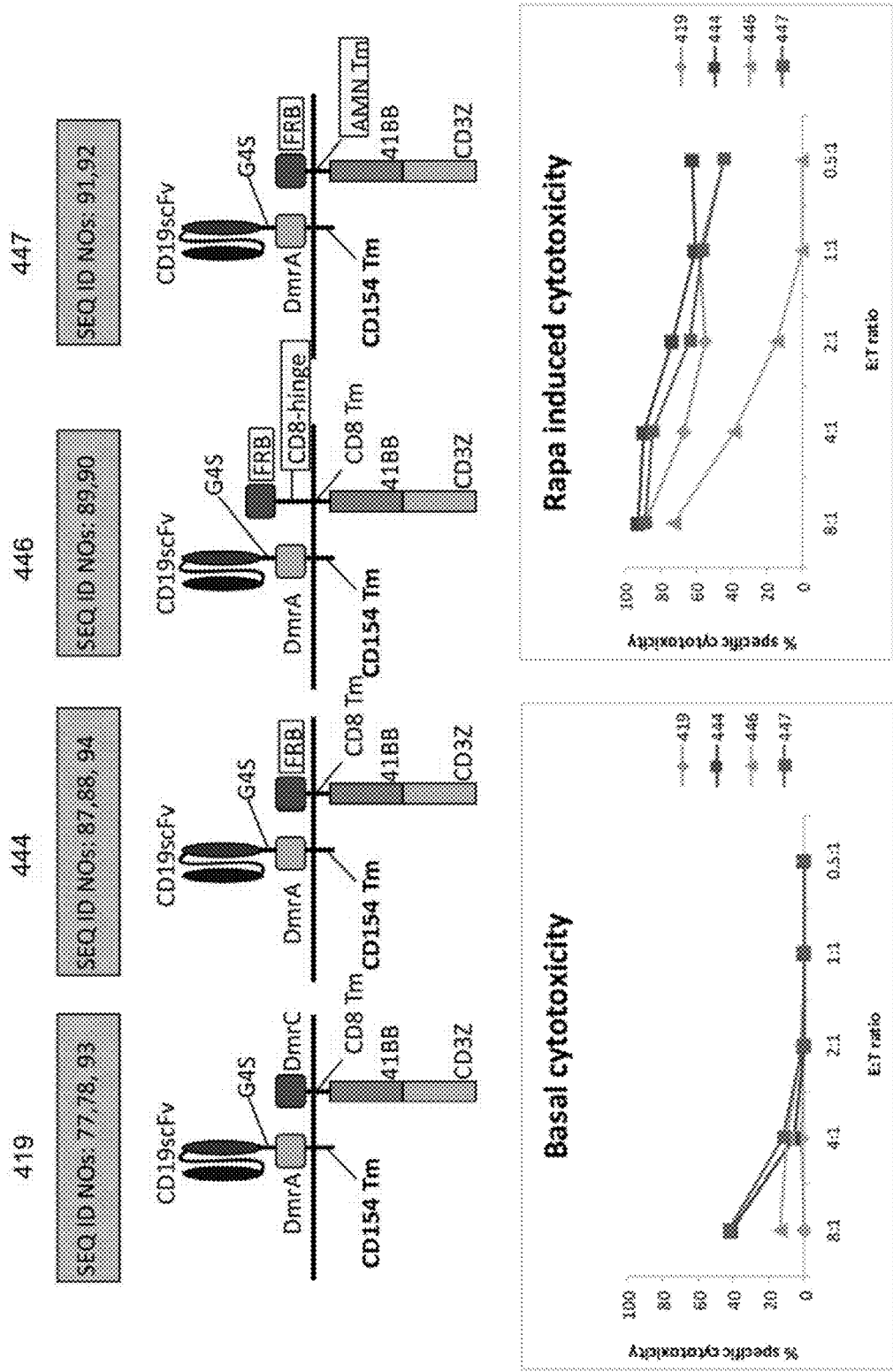
Figure 15B:
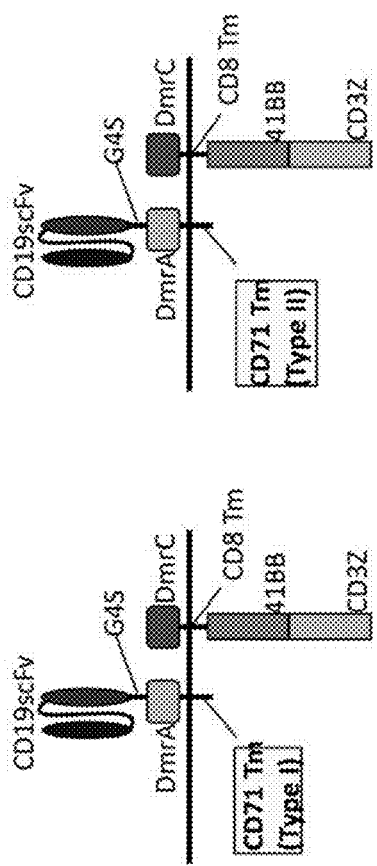

FIG. 15A shows that T cells expressing DARIC complexes comprising alternative transmembrane domains (CD154 TM) have increased antigen specific cytotoxicity in the presence a bridging factor and also show little or no basal cytotoxicity in the absence of the bridging factor. FIG. 15B shows that T cells expressing DARIC complexes comprising alternative transmembrane domains (CD71 TM) or transmembrane topology maintain antigen specific cytotoxicity in the presence a bridging factor and also show reduced basal cytotoxicity in the absence of the bridging factor.

DETAILED DESCRIPTION

In one embodiment, multi-component fusion proteins for use in modulating a biological response to immunotherapy, such as adoptive immunotherapy, are provided. By way of background, signal transduction by cell surface receptors converts extracellular information into intracellular responses and requires machinery for both ligand recognition and transmembrane signal transduction. Cell surface receptors recognize ligands through the use of an extracellular binding domain and, upon ligand binding, transduce signals across the plasma membrane via membrane spanning domains connected with intracellular signaling domains. These occur either as single-chain units, where binding and signaling are linked directly, or through multi-chain contacts whereby cell surface binding of ligand allows intracellular interactions of signaling domains with other proteins to mediate cell signal transduction.

An advantage of the compositions and methods contemplated herein is to provide both spatial and temporal control over such signal transduction binding and signaling activities. Since the binding component is expressed on the surface, or delivered in a recombinant form, it is then present in the extracellular environment without being basally coupled to any cell signal transduction machinery. The transmembrane signaling fusion protein to be expressed by the cell of interest comprises one or more intracellular signaling (actuator) domains fused via a transmembrane domain to an extracellular multimerization domain, such as a FRB or FKBP12 protein (whichever is not present on the binding component).

In one embodiment, this disclosure provides a binding component and a signaling component that are each expressed as separate fusion proteins, but contain an extracellular multimerization mechanism (bridging factor) for recoupling of the two functional components on a cell surface—referred to herein as DARIC binding and signaling components—which provides temporal control. In particular embodiments, DARIC components have surprisingly low or negligible recoupling in the absence of the bridging factor but still maintain potent cell signaling properties in the presence of bridging factor.

But, the temporal control achieved through the multimerization mechanism described herein only primes the machinery for signaling. The chemically induced multimerization reconstitutes a signaling-potentiated receptor, but it does not activate downstream signaling because there is no aggregation of intracellular signaling components. Spatial control is, therefore, achieved on the basis of the presence or absence of a target recognized by the binding domain on the binding component. Since the binding component fusion protein is displayed on the outside of the cell, it only localizes to cells expressing the target antigen, such that cells will only become activated when both target antigen (e.g., cell surface antigen) and the bridging factor are present.

Figure 1A:
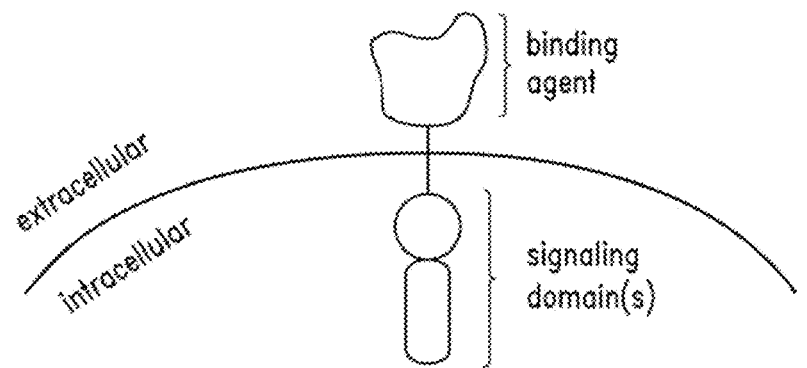
FIGS. 1A-1M show schematics of various types of multipartite signaling complexes of this disclosure.
Figure 1A:
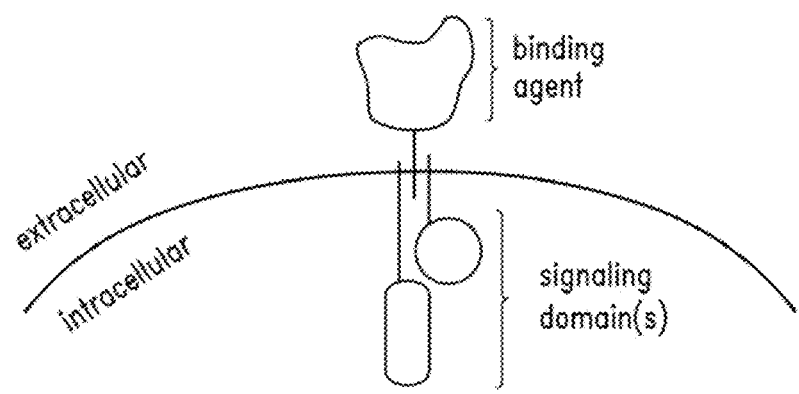
Figure 1B:
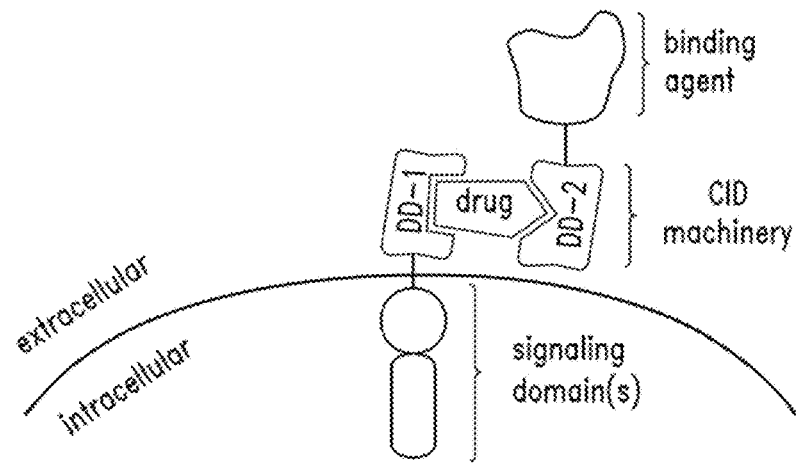
Figure 1B:
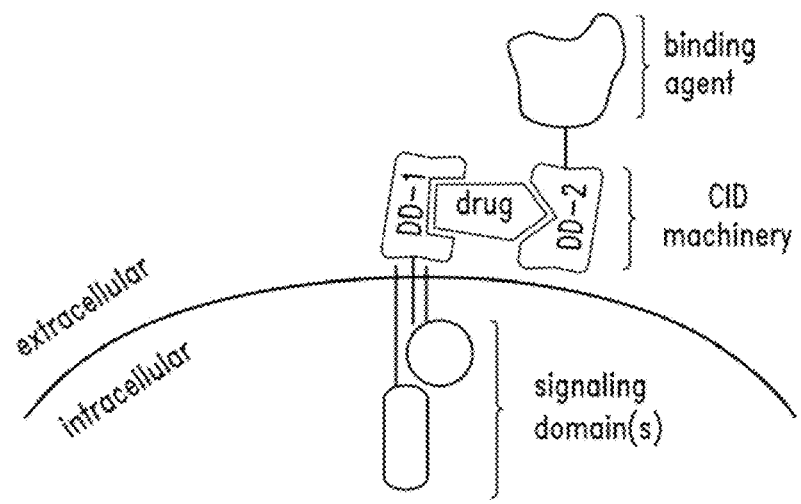
Figure 1C:
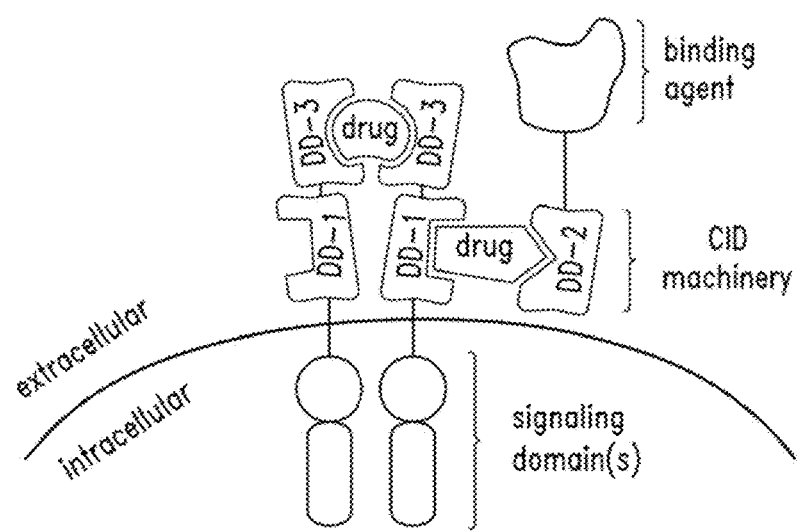
Figure 1D:
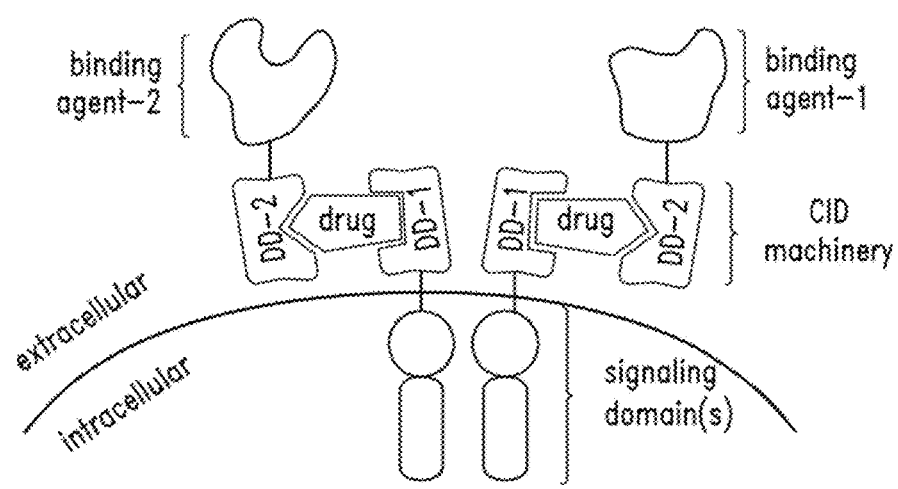
Figure 1E:
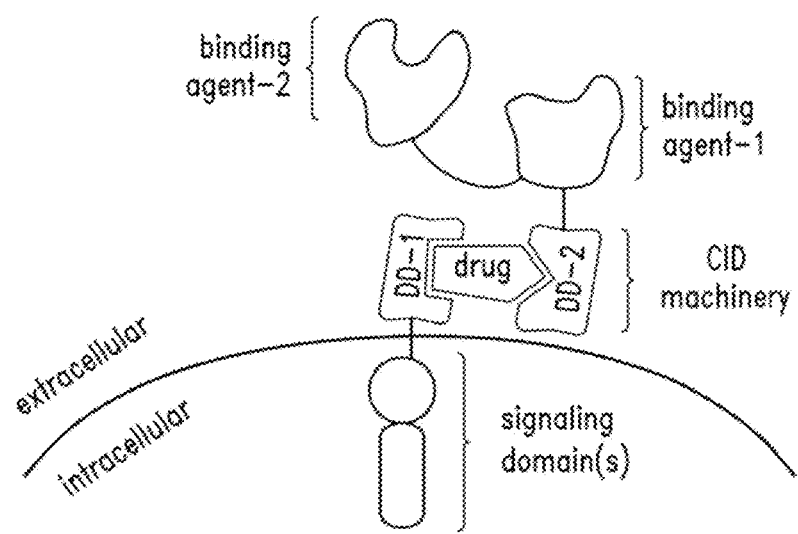
Figure 1F:
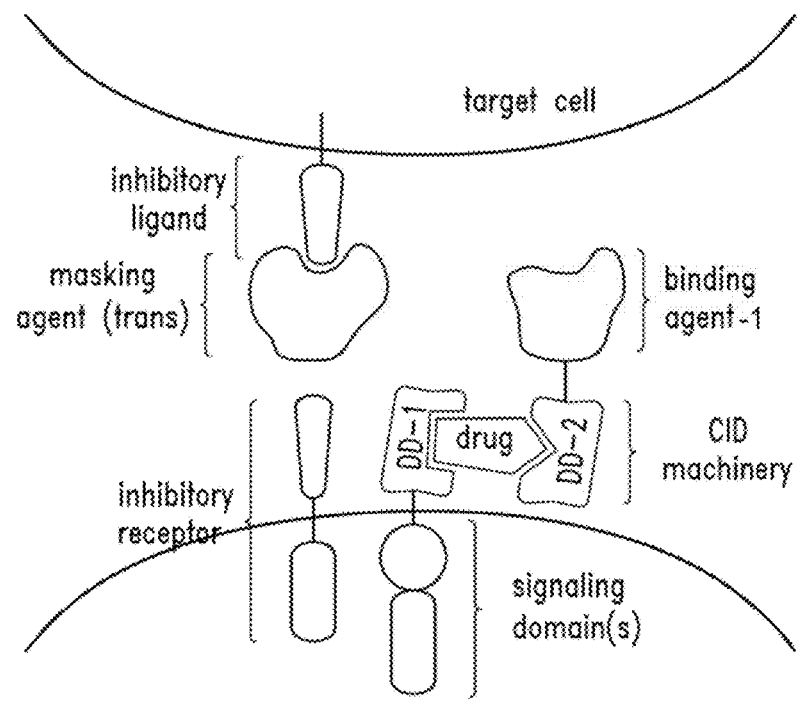
Figure 1G:
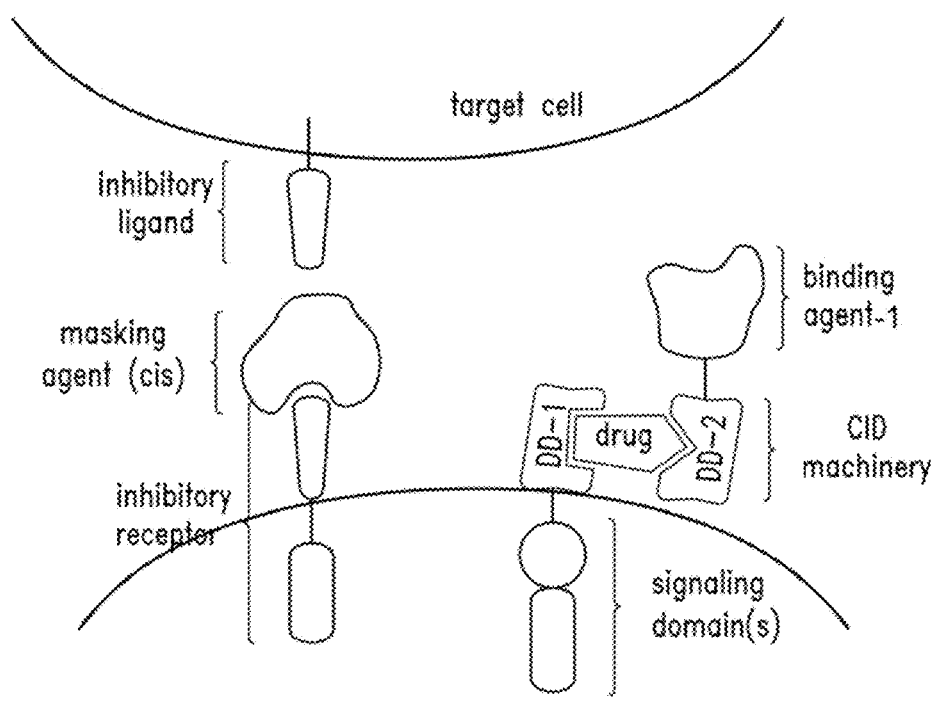
Figure 1H:
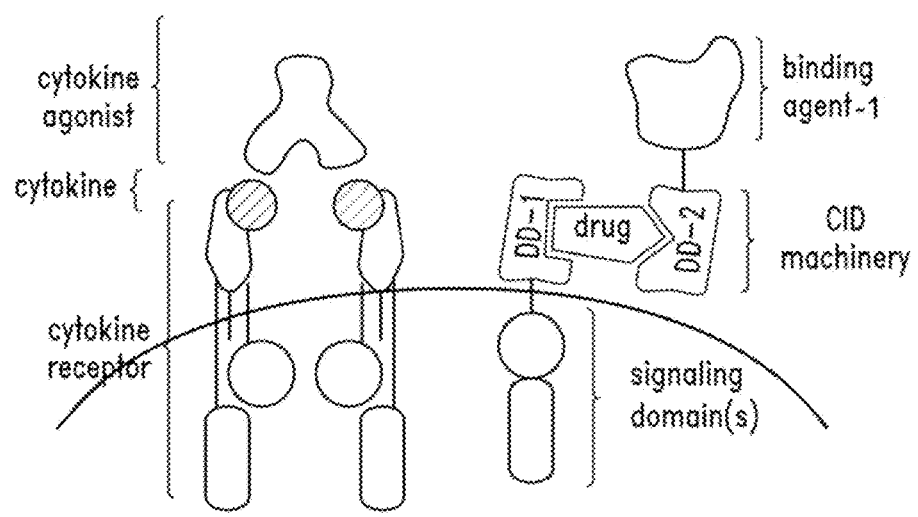

In certain embodiments, a recombinant or non-natural cell comprises a first nucleic acid molecule encoding a first fusion protein comprising a first multimerization domain, a first hydrophobic domain, and an actuator domain, wherein the first multimerization domain localizes extracellularly when the first fusion protein is expressed is administered to a subject having a hyperproliferative disease (e.g., cancer), an inflammatory disease, an autoimmune disease, or a graft-versus-host disease. Such a fusion protein can be referred to as a DARIC signaling component, which may be expressed as one or more transmembrane protein(s). A DARIC signaling component may contain more than one multimerization domain, including a multimerization domain that promotes homodimerization in the presence of homo-bivalent bridging factor. In such an embodiment (see FIG. 1c), the administration of a bridging factor will promote some level of basal signaling in the absence of binding to an extracellular target—for example, as a way to drive cell proliferation in vitro or in vivo prior to activation with a DARIC binding component (which in this context functions like a drug). For T cells, it is known that lower level activation promotes proliferation, whereas the higher order multimerization (as would occur by high density of antigen on a target cell and heterodimerization of the DARIC components with a bridging component) would lead to activation of a cytotoxicity response.

In further embodiments, a subject receiving a recombinant (non-natural) cell (e.g., T cell) expressing a DARIC signaling component and a fusion protein comprising a binding domain, a multimerization domain, and a hydrophobic domain (e.g., CD154 or CD71 transmembrane domain)—a DARIC binding component—and a bridging factor (e.g., rapamycin or rapalog thereof) to promote the formation of a polypeptide complex on the non-natural cell surface with the bridging factor associated with and disposed between the multimerization domains of the first and second fusion proteins (DARIC signaling and binding components, respectively). In certain embodiments, a nucleic acid molecule further encodes a fusion protein comprising a secretion signal, a binding domain, a multimerization domain, and a hydrophobic domain wherein the fusion protein (DARIC binding component) is secreted from the non-natural cell when expressed. In some embodiments, a nucleic acid molecule further encodes a fusion protein comprising a secretion signal, a binding domain, a multimerization domain, and a hydrophobic domain wherein the expressed fusion protein (DARIC binding component) is expressed on the cell surface of the non-natural cell (see FIG. 1I-K). The DARIC binding component will specifically bind to a target cell (e.g., cancer, autoimmune) either before or after associating with the DARIC signaling component through the bridging factor, wherein in the absence of the bridging factor the complex will not elicit an appreciable cellular response, and wherein the tripartite association of the two DARIC components and bridging factor will trigger a cellular response that treats the hyperproliferative, inflammatory, autoimmune, or graft-versus-host disease. For example, the presence at least one DARIC binding component and a cell surface target would lead to increasing signals proportional to the density of target due to multimerization.

In a further embodiment, the DARIC signaling component may be created by leveraging existing activating receptors on the cell (e.g., T cell) surface using a drug regulated bi-specific engager (BiTE). In this instance, both DARIC components are secreted: a binding component that binds to a target cell, and a signaling component that binds to a receptor (e.g., the TCR/CD3 complex) on a T cell. In one embodiment, a non-natural cell secretes both components. In another embodiment, one or more non-natural cells secretes one or more of the components.

In a particular embodiment, a non-natural cell further comprises a deconstructed drug regulated bispecific T cell engager (BiTE) expressed as separate fusion proteins is provided. The BiTE comprises a DARIC signaling component comprising a binding agent that binds a T cell receptor and a first multimerization domain; and a DARIC binding component comprising a binding agent that binds an antigen on a target cell and a second multimerization domain, such as a FRB or FKBP12 protein (whichever is not present on the binding component). Only upon the application of the FRB/FKBP12 coupling drug (e.g., rapamycin or a rapalog thereof) do the BiTE components form a complex that is capable of initiating signal transduction.

Figure 15B:
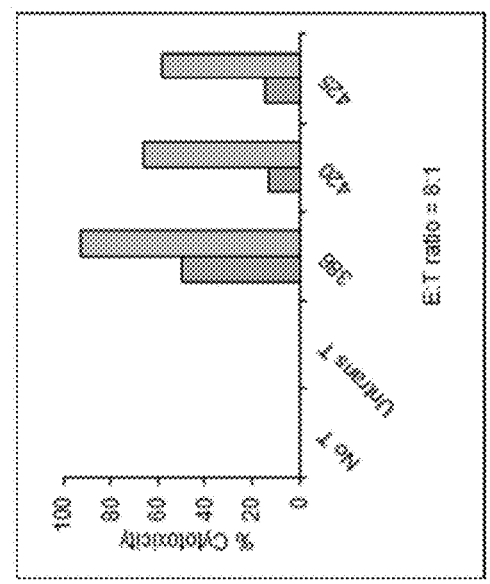

In particular preferred embodiments, DARIC signaling and binding components are provided that exhibit potent antigen specific cytotoxic responses in the presence of a bridging factor and minimal or non-detectable cytotoxic activity in the absence of the bridging factor, e.g., FIG. 15.

Prior to setting forth this disclosure in more detail, it may be helpful to an understanding thereof to provide definitions of certain terms to be used herein. Additional definitions are set forth throughout this disclosure.

Reference throughout this specification to "one embodiment," "an embodiment," "a particular embodiment," "a related embodiment," "a certain embodiment," "an additional embodiment," or "a further embodiment" or combinations thereof means that a particular feature, structure or characteristic described in connection with the embodiment is included in at least one embodiment of the present invention. Thus, the appearances of the foregoing phrases in various places throughout this specification are not necessarily all referring to the same embodiment. Furthermore, the particular features, structures, or characteristics may be combined in any suitable manner in one or more embodiments. It is also understood that the positive recitation of a feature in one embodiment, serves as a basis for excluding the feature in a particular embodiment.

In the present description, any concentration range, percentage range, ratio range, or integer range is to be understood to include the value of any integer within the recited range and, when appropriate, fractions thereof (such as one tenth and one hundredth of an integer), unless otherwise indicated. Also, any number range recited herein relating to any physical feature, such as polymer subunits, size or thickness, are to be understood to include any integer within the recited range, unless otherwise indicated. As used herein, the terms "about" means (1) ±1%, ±2%, ±3%, ±4%, ±5%, ±10%, ±15%, or ±20% of the indicated range, value or structure; (2) a value includes the inherent variation of error for the method being employed to determine the value; or (3) a value includes the variation that exists among replicate experiments, unless otherwise indicated. It should be understood that the terms "a" and "an" as used herein refer to "one or more" of the enumerated components. The use of the alternative (e.g., "or") should be understood to mean either one, both, or any combination thereof of the alternatives or enumerated components. As used herein, the terms "include," "have" and "comprise" are used synonymously, which terms and variants thereof are intended to be construed as non-limiting.

As used herein, a protein or polypeptide "consists essentially of" several domains (e.g., a binding domain, a linker or spacer, a hydrophobic domain, a multimerization domain, an actuator domain) when the portions outside of the several domains (e.g., amino acids at the amino- or carboxy-terminus or between two domains), in combination, contribute to at most 20% (e.g., at most 15%, 10%, 8%, 6%, 5%, 4%, 3%, 2% or 1%) of the length of the protein or polypeptide and do not substantially affect (i.e., do not alter the activity by more than 50%, such as no more than 40%, 30%, 25%, 20%, 15%, 10%, 5%, 4%, 3%, 2%, 1%) the activities of one or more of the various domains (e.g., the target binding affinity of the binding domain, the capability of the multimerization domain to facilitate complex formation, and the capability of the actuator domain to transmit functional signals to a cell). In certain embodiments, a protein (e.g., a single chain polypeptide) consists essentially of a binding domain that specifically binds a target, a linker, and a multimerization domain, wherein the protein may comprise junction amino acids at the amino- and/or carboxy-terminus of the protein or between two different domains (e.g., between the binding domain and the multimerization domain, between the multimerization domain and the linker).

A "fusion protein" or "chimeric protein," as used herein, refers to a protein that includes polypeptide components derived from one or more parental proteins or polypeptides and does not naturally occur in a host cell. A fusion protein will contain two or more naturally-occurring amino acid sequences that are linked together in a way that does not occur naturally. For example, a fusion protein may have two or more portions from the same protein linked in a way not normally found in a cell, or a fusion protein may have portions from two, three, four, five or more different proteins linked in a way not normally found in a cell. A fusion protein can be encoded by a nucleic acid molecule wherein a nucleotide sequence encoding one protein or portion thereof is appended in frame with, and optionally separated by nucleotides that encode a linker, spacer or junction amino acids, a nucleic acid molecule that encodes one or more different proteins or a portion thereof. In certain embodiments, a nucleic acid molecule encoding a fusion protein is introduced into a host cell and expressed.

As used herein, the term "host" refers to a cell (e.g., T cell) or microorganism that may be genetically modified with an exogenous nucleic acid molecule to produce a polypeptide of interest (e.g., DARIC binding or signaling components). In certain embodiments, a host cell may optionally already possess or be modified to include other genetic modifications that confer desired properties related or unrelated to fusion protein biosynthesis (e.g., deleted, altered or truncated TCR; increased costimulatory factor expression). In certain embodiments, a host cell is a human T cell or a human T cell with TCRα, TCRβ, or both knocked out with a site-specific nuclease (e.g., a LAGLIDADG homing endonuclease, LHE).

As used herein, "recombinant" or "non-natural" refers to an organism, microorganism, cell, nucleic acid molecule, or vector that has at least one engineered genetic alteration or has been modified by the introduction of a heterologous nucleic acid molecule, or refers to a cell that has been altered such that the expression of an endogenous nucleic acid molecule or gene can be controlled. Recombinant also refers to a cell that is derived from a non-natural cell or is progeny of a non-natural cell having one or more such modifications. Genetic alterations include, for example, modifications introducing expressible nucleic acid molecules encoding proteins, or other nucleic acid molecule additions, deletions, substitutions or other functional alteration of a cell's genetic material. For example, recombinant cells may express genes or other nucleic acid molecules that are not found in identical or homologous form within a native (wild-type) cell (e.g., a fusion or chimeric protein), or may provide an altered expression pattern of endogenous genes, such as being over-expressed, under-expressed, minimally expressed, or not expressed at all.

Recombinant methods for expression of exogenous or heterologous nucleic acids in cells are well known in the art. Such methods can be found described in, for example, Sambrook et al., *Molecular Cloning: A Laboratory Manual*, Third Ed., Cold Spring Harbor Laboratory, New York (2001); and Ausubel et al., *Current Protocols in Molecular Biology*, John Wiley and Sons, Baltimore, Md. (1999). Exemplary exogenous proteins or enzymes to be expressed include scFv, CD3ζ, FKBP, FRB, cytokines, or any combination thereof. Genetic modifications to nucleic acid molecules encoding fusion proteins can confer a biochemical or metabolic capability to a recombinant or non-natural cell that is altered from its naturally occurring state.

As used herein, the term "endogenous" or "native" refers to a gene, protein, compound or activity that is normally present in a host cell. The term "homologous" or "homolog" refers to a molecule or activity from an exogenous (non-native) source that is the same or similar molecule or activity as that found in or derived from a host cell, species or strain.

As used herein, "heterologous" nucleic acid molecule, construct or sequence refers to a nucleic acid molecule or portion of a nucleic acid molecule sequence that is not native to a cell in which it is expressed, a nucleic acid molecule or portion of a nucleic acid molecule native to a host cell that has been altered or mutated, or a nucleic acid molecule with an altered expression as compared to the native expression levels under similar conditions. For example, a heterologous control sequence (e.g., promoter, enhancer) may be used to regulate expression of a gene or a nucleic acid molecule in a way that is different than the gene or a nucleic acid molecule that is normally expressed in nature or culture. In certain embodiments, a heterologous nucleic acid molecule may be homologous to a native host cell gene, but may have an altered expression level or have a different sequence or both. In other embodiments, heterologous or exogenous nucleic acid molecules may not be endogenous to a host cell or host genome (e.g., fusion protein), but instead may have been introduced into a host cell by transformation (e.g., transfection, electroporation), wherein the added molecule may integrate into the host genome or can exist as extra-chromosomal genetic material either transiently (e.g., mRNA) or stably for more than one generation (e.g., episomal viral vector, plasmid or other self-replicating vector).

In certain embodiments, more than one heterologous or exogenous nucleic acid molecule can be introduced into a host cell as separate nucleic acid molecules, as a polycistronic nucleic acid molecule, as a single nucleic acid molecule encoding a fusion protein, or any combination thereof, and still be considered as more than one heterologous or exogenous nucleic acid. When two or more exogenous nucleic acid molecules are introduced into a host cell, it is understood that the two more exogenous nucleic acid molecules can be introduced as a single nucleic acid molecule (e.g., on a single vector), on separate vectors, as single or multiple mRNA molecules, integrated into the host chromosome at a single site or multiple sites, and each of these embodiments is still to be considered two or more exogenous nucleic acid molecules. Thus, the number of referenced heterologous nucleic acid molecules or protein activities refers to the number of encoding nucleic acid molecules or the number of protein activities, not the number of separate nucleic acid molecules introduced into a host cell.

For example, a cell can be modified to express two or more heterologous or exogenous nucleic acid molecules, which may be the same or different, that encode one or more fusion proteins, as disclosed herein. In certain embodiments, a host cell will contain a first nucleic acid molecule encoding a first fusion protein and a separate second nucleic acid molecule encoding a second fusion protein, or a host cell will contain a single polycistronic nucleic acid molecule that encodes a first fusion protein and second fusion protein, or single nucleic acid molecule that encodes a first fusion protein, a self-cleaving amino acid sequence and a second fusion protein.

Suitable protease cleavages sites and self-cleaving peptides are known to the skilled person (see, e.g., in Ryan et al., 1997. *J. Gener. Virol.* 78, 699-722; Scymczak et al. (2004) *Nature Biotech.* 5, 589-594). Exemplary protease cleavage sites include, but are not limited to the cleavage sites of potyvirus NIa proteases (e.g., tobacco etch virus protease), potyvirus HC proteases, potyvirus P1 (P35) proteases, byovirus NIa proteases, byovirus RNA-2-encoded proteases, aphthovirus L proteases, enterovirus 2A proteases, rhinovirus 2A proteases, picorna 3C proteases, comovirus 24K proteases, nepovirus 24K proteases, RTSV (rice tungro spherical virus) 3C-like protease, PYVF (parsnip yellow fleck virus) 3C-like protease, heparin, thrombin, factor Xa and enterokinase. Due to its high cleavage stringency, TEV (tobacco etch virus) protease cleavage sites are preferred in one embodiment, e.g., EXXYXQ(G/S), for example, ENLYFQG and ENLYFQS, wherein X represents any amino acid (cleavage by TEV occurs between Q and G or Q and S).

In certain embodiments, the self-cleaving polypeptide site comprises a 2A or 2A-like site, sequence or domain (Donnelly et al., 2001. *J. Gen. Virol.* 82:1027-1041). In a particular embodiment, the viral 2A peptide is an aphthovirus 2A peptide, a potyvirus 2A peptide, or a cardiovirus 2A peptide.

In one embodiment, the viral 2A peptide is selected from the group consisting of: a foot-and-mouth disease virus (FMDV) 2A peptide, an equine rhinitis A virus (ERAV) 2A peptide, a Thosea asigna virus (TaV) 2A peptide, a porcine teschovirus-1 (PTV-1) 2A peptide, a Theilovirus 2A peptide, and an encephalomyocarditis virus 2A peptide.

A "polypeptide complex" or "protein complex," as used herein, refers to a dimer, trimer, or higher order multimer formed by at least two different single chain polypeptides, comprising at least one chain having a binding domain specific for a target and one chain having an actuator domain. This term does not include an antibody formed from four single chain polypeptides (i.e., two light chains and two heavy chains). A "dimer" refers to a biological entity that contains two subunits associated with each other, and a "polypeptide complex" refers to a biological entity that includes at least two proteins subunits and a bridging factor associated with each other, via one or more forms of intramolecular forces, including covalent bonds (e.g., disulfide bonds) and other interactions (e.g., electrostatic interactions, salt bridges, hydrogen bonding, and hydrophobic interactions), and is stable under appropriate conditions (e.g., under physiological conditions, in an aqueous solution suitable for expressing, purifying, and/or storing recombinant proteins, or under conditions for non-denaturing and/or non-reducing electrophoresis).

A "single chain polypeptide" is a single, linear and contiguous arrangement of covalently linked amino acids. It does not include two polypeptide chains that link together in a non-linear fashion, such as via an interchain disulfide bond (e.g., a half immunoglobulin molecule in which a light chain links with a heavy chain via a disulfide bond). In certain embodiments, a single chain polypeptide may have or form one or more intrachain disulfide bonds. In certain other embodiments, two or more single chain polypeptides (e.g., fusion proteins) may associate via an interchain disulfide bond to provide a potentially active complex provided the complex is made up of at least one non-natural protein, such as fusion or chimeric proteins and is not a natural antibody.

A "multimerization domain," as used herein, refers to a polypeptide molecule that preferentially interacts or associates with another different polypeptide molecule directly or via a bridging molecule, wherein the interaction of the different multimerization domains substantially contribute to or efficiently promote multimerization (i.e., the formation of a dimer, trimer, or multipartite complex, which may be a homodimer, heterodimer, homotrimer, heterotrimer, homomultimer, heteromultimer). Representative multimerization domains of the present disclosure include an FKBP, FRB, calcineurin, cyclophilin, bacterial DHFR, PYL1, ABI1, GIB1, GAI, or variants thereof, as provided herein.

In certain embodiments, a polypeptide complex comprises (i) a first fusion protein having a first multimerization domain and (ii) second fusion protein having a second multimerization domain that is not the same as the first multimerization domain, wherein the first and second multimerization domains substantially contribute to or efficiently promote formation of the polypeptide complex in the presence of a bridging factor. The interaction(s) between the first and second multimerization domains substantially contributes to or efficiently promotes the multimerization of the first and second fusion proteins if there is a statistically significant reduction in the association between the first and second fusion proteins in the absence of the first multimerization domain, the second multimerization domain, or the bridging factor. In certain embodiments, when the first and second fusion proteins are co-expressed, at least about 60%, for instance, at least about 60% to about 70%, at least about 70% to about 80%, at least about 80% to about 90%, 91%, 92%, 93%, 94%, 95%, 96%, 97%, 98%, 99%, or 100%, and at least about 90% to about 92%, 93%, 94%, 95%, 96%, 97%, 98%, or 99% of the first and second single chain polypeptides form multimers with each other in the presence of a bridging factor.

As used herein, "hydrophobic domain" refers to an amino acid sequence having a three-dimensional structure that is thermodynamically stable in a cell membrane. The structure of a hydrophobic domain may comprise an alpha helix, a beta barrel, a beta sheet, a beta helix, or any combination thereof. In certain embodiments, a hydrophobic domain is a transmembrane domain, such as one derived from an integral membrane protein (e.g., receptor, cluster of differentiation (CD) molecule, enzyme, transporter, cell adhesion molecule, or the like).

As used herein, "anchor domain" refers to an amino acid sequence or other molecule that promotes tethering, anchoring or association of a fusion protein of this disclosure with a cell surface. Exemplary anchor domains include an amino acid sequence with a structure that is stable in a cell membrane or an amino acid sequence that promotes the addition of a glycolipid (also known as glycosyl phosphatidylinositols or GPIs), or the like. By way of background, a GPI molecule is post-translationally attached to a protein target by a transamidation reaction, which results in the cleavage of a carboxy-terminal GPI signal sequence (see, e.g., White et al., *J. Cell Sci.* 113:721, 2000) and the simultaneous transfer of the already synthesized GPI anchor molecule to the newly formed carboxy-terminal amino acid (see www.ncbi.nlm.nih.gov/books/NBK20711 for exemplary GPI anchors, which GPI anchors are incorporated by reference in their entirety. In certain embodiments, an anchor domain is a hydrophobic domain (e.g., transmembrane domain) or a GPI signal sequence. In some embodiments, a nucleic acid molecule encoding a fusion protein of this disclosure with an anchor domain results in a fusion protein further comprising a GPI molecule.

An "actuator domain," as used herein, directly or indirectly, promotes a biological or physiological response in a cell when receiving the appropriate signal. In certain embodiments, the actuator domain is part of a protein or protein complex that receives a signal when bound or it binds to a target molecule and the binding triggers a signal from the actuator domain. The actuator domain may directly promote a cellular response when it contains signaling domains or motifs, such as an immunoreceptor tyrosine-based activation motif (ITAM). In other embodiments, an actuator domain will indirectly promote a cellular response by associating with one or more other proteins that directly promote a cellular response. Exemplary actuator domains include CD2, CD3ε, CD3δ, CD3ζ, pTα, TCRα, TCRβ, FcRα, FcRβ, FcRγ, NKG2D, CD79A, CD79B, CD22, CD27, CD28, CD30, CD40, LAT, Zap70, ICOS, DAP10, 4-1BB, CARD11, HVEM, LAG3, SLAMF1, Lck, Fyn, Slp76, TRIM, OX40, or any combination thereof.

In particular embodiments, a "transmembrane domain" refers to a portion of the signaling component that fuses an extracellular multimerization domain and one or more intracellular signaling domains and anchors the signaling component to the plasma membrane of the T cell. In one embodiment, the transmembrane domain may be heterologous to other domains of the fusion polypeptides contemplated herein. In certain embodiments, a "transmembrane domain" refers to a portion of the binding component that is fused to an extracellular multimerization domain and anchors the binding component to the plasma membrane of the T cell. The transmembrane domain may be derived either from a natural, synthetic, semi-synthetic, or recombinant source. Illustrative transmembrane domains may be derived from (i.e., comprise at least the transmembrane region(s) of) the alpha, beta or zeta chain of the T-cell receptor, CD3ε, CD3ζ, CD4, CD5, CD8α, CD9, CD16, CD22, CD27, CD28, CD33, CD37, CD45, CD64, CD71, CD80, CD86, CD134, CD137, CD152, CD154, AMN, and PD1. In various embodiments, a transmembrane domain of a binding component and/or signaling component is fused to a short oligo- or polypeptide linker, preferably between 1, 2, 3, 4, 5, 6, 7, 8, 9, or 10 amino acids in length and that optionally links the transmembrane domain and the intracellular signaling domain of the signaling component. In particular embodiments, a fusion protein contemplated herein comprises a type I transmembrane domain. In other embodiments, a fusion protein contemplated herein comprises a type II transmembrane domain. In certain embodiments, a fusion protein contemplated herein comprises a type I transmembrane domain that has been converted to a type I transmembrane domain from a type II transmembrane domain. In other embodiments, a fusion protein contemplated herein comprises a type II transmembrane domain that has been converted to a type II transmembrane domain from a type I transmembrane domain.

A "binding domain" (also referred to as a "binding region," "binding agent," or "binding moiety"), as used herein, refers to one or more proteins, polypeptides, oligopeptides, or peptides that possesses the ability to specifically recognize and bind to a target (e.g., CD19, CD20). A binding domain includes any naturally occurring, synthetic, semi-synthetic, or recombinantly produced binding partner for a biological molecule or another target of interest. Exemplary binding domains include single chain antibody variable regions (e.g., domain antibodies, sFv, scFv, Fab), receptor ectodomains (e.g., c-Met), or ligands (e.g., cytokines, chemokines, or cell surface associated ligands). In particular embodiments, a binding domain comprises an antibody or antigen binding fragment thereof, including but not limited to a Camel Ig (a camelid antibody (VHH)), Ig NAR, Fab fragments, Fab' fragments, F(ab)'2 fragments, F(ab)'3 fragments, Fv, single chain Fv antibody ("scFv"), bis-scFv, (scFv)2, minibody, diabody, triabody, tetrabody, disulfide stabilized Fv protein ("dsFv"), and single-domain antibody (sdAb, Nanobody). A variety of assays are known for identifying binding domains of the present disclosure that specifically bind a particular target, including Western blot, ELISA, and Biacore analysis.

A binding domain and a fusion protein thereof "specifically binds" a target if it binds the target with an affinity or $K_a$ (i.e., an equilibrium association constant of a particular binding interaction with units of 1/M) equal to or greater than $10^5$ $M^{-1}$, while not significantly binding other components present in a test sample. Binding domains (or fusion proteins thereof) may be classified as "high affinity" binding domains (or fusion proteins thereof) and "low affinity" binding domains (or fusion proteins thereof). "High affinity" binding domains refer to those binding domains with a $K_a$ of at least $10^7$ $M^{-1}$, at least $10^8$ $M^{-1}$, at least $10^9$ $M^{-1}$, at least $10^{10}$ $M^{-1}$, at least $10^{11}$ $M^{-1}$, at least $10^{12}$ $M^{-1}$, or at least $10^{13}$ $M^{-1}$. "Low affinity" binding domains refer to those binding domains with a $K_a$ of up to $10^7$ $M^{-1}$, up to $10^6$ $M^{-1}$, up to $10^5$ $M^{-1}$. Alternatively, affinity may be defined as an equilibrium dissociation constant ($K_d$) of a particular binding interaction with units of M (e.g., $10^{-5}$ M to $10^{-13}$ M). Affinities of binding domain polypeptides and fusion proteins according to the present disclosure can be readily determined using conventional techniques (see, e.g., Scatchard et al. (1949) Ann. N.Y. Acad. Sci. 51:660; and U.S. Pat. Nos. 5,283,173, 5,468,614, or the equivalent).

"T cell receptor" (TCR) is a molecule found on the surface of T cells that, along with CD3, is generally responsible for recognizing antigens bound to major histocompatibility complex (MHC) molecules. It consists of a disulfide-linked heterodimer of the highly variable α and β chains in most T cells. In other T cells, an alternative receptor made up of variable γ and δ chains is expressed. Each chain of the TCR is a member of the immunoglobulin superfamily and possesses one N-terminal immunoglobulin variable domain, one immunoglobulin constant domain, a transmembrane region, and a short cytoplasmic tail at the C-terminal end (see, Abbas and Lichtman, *Cellular and Molecular Immunology* (5th Ed.), Editor: Saunders, Philadelphia, 2003; Janeway et al., *Immunobiology: The Immune System in Health and Disease*, 4th Ed., Current Biology Publications, p 148, 149, and 172, 1999). TCR as used in the present disclosure may be from one or various animal species, including human, mouse, rat, or other mammals.

"CD3" is known in the art as a multi-protein complex of six chains (see, Abbas and Lichtman, 2003; Janeway et al., p 172 and 178, 1999). In mammals, the complex comprises a CD3γ chain, a CD3δ chain, two CD3ε chains, and a homodimer of CD3ζ chains. The CD3γ, CD3δ, and CD3ε chains are highly related cell surface proteins of the immunoglobulin superfamily containing a single immunoglobulin domain. The transmembrane regions of the CD3γ, CD3δ, and CD3ε chains are negatively charged, which is a characteristic that allows these chains to associate with the positively charged T cell receptor chains. The intracellular tails of the CD3γ, CD3δ, and CD3ε chains each contain a single conserved motif known as an immunoreceptor tyrosine-based activation motif or ITAM, whereas each CD3ζ chain has three. It is believed the ITAMs are important for the signaling capacity of a TCR complex. CD3 as used in the present disclosure may be from one or various animal species, including human, mouse, rat, or other mammals.

"TCR complex," as used herein, refers to a complex formed by the association of CD3 with TCR. For example, a TCR complex can be composed of a CD3γ chain, a CD3δ chain, two CD3ε chains, a homodimer of CD3ζ chains, a TCRα chain, and a TCRβ chain. Alternatively, a TCR complex can be composed of a CD3γ chain, a CD3δ chain, two CD3ε chains, a homodimer of CD3ζ chains, a TCRγ chain, and a TCRδ chain.

"A component of a TCR complex," as used herein, refers to a TCR chain (i.e., TCRα, TCRβ, TCRγ or TCRδ), a CD3 chain (i.e., CD3γ, CD3δ, CD3ε or CD3ζ), or a complex formed by two or more TCR chains or CD3 chains (e.g., a complex of TCRα and TCRβ, a complex of TCRγ and TCRδ, a complex of CD3ε and CD3δ, a complex of CD3γ and CD3ε, or a sub-TCR complex of TCRα, TCRβ, CD3γ, CD3δ, and two CD3ε chains).

Terms understood by those in the art of antibody technology are each given the meaning acquired in the art, unless expressly defined differently herein. Antibodies are known to have variable regions, a hinge region, and constant domains. Immunoglobulin structure and function are reviewed, for example, in Harlow et al., Eds., Antibodies: A Laboratory Manual, Chapter 14 (Cold Spring Harbor Laboratory, Cold Spring Harbor, 1988).

For example, the terms "VL" and "VH" refer to the variable binding region from an antibody light and heavy chain, respectively. The variable binding regions are made up of discrete, well-defined sub-regions known as "complementarity determining regions" (CDRs) and "framework regions" (FRs). The term "CL" refers to an "immunoglobulin light chain constant region" or a "light chain constant region," i.e., a constant region from an antibody light heavy chain. The term "CH" refers to an "immunoglobulin heavy chain constant region" or a "heavy chain constant region," which is further divisible, depending on the antibody isotype into CH1, CH2, and CH3 (IgA, IgD, IgG), or CH1, CH2, CH3, and CH4 domains (IgE, IgM). A "Fab" (fragment antigen binding) is the part of an antibody that binds to antigens and includes the variable region and CH1 of the heavy chain linked to the light chain via an inter-chain disulfide bond.

As used herein, "an Fc region constant domain portion" or "Fc region portion" refers to the heavy chain constant region segment of the Fc fragment (the "fragment crystallizable" region or Fc region) from an antibody, which can include one or more constant domains, such as CH2, CH3, CH4, or any combination thereof. In certain embodiments, an Fc region portion includes the CH2 and CH3 domains of an IgG, IgA, or IgD antibody and any combination thereof, or the CH3 and CH4 domains of an IgM or IgE antibody and any combination thereof. In one embodiment, the CH2CH3 or the CH3CH4 structures are from the same antibody isotype, such as IgG, IgA, IgD, IgE, or IgM. By way of background, the Fc region is responsible for the effector functions of an immunoglobulin, such as ADCC (antibody-dependent cell-mediated cytotoxicity), ADCP (antibody-dependent cellular phagocytosis), CDC (complement-dependent cytotoxicity) and complement fixation, binding to Fc receptors (e.g., CD16, CD32, FcRn), greater half-life in vivo relative to a polypeptide lacking an Fc region, protein A binding, and perhaps even placental transfer (see Capon et al., Nature, 337:525 (1989)).

A "linker" or "spacer" refers to an amino acid sequence that connects two proteins, polypeptides, peptides, domains, regions, or motifs and may provide a spacer function compatible with interaction of the two sub-binding (e.g., multimerization) domains so that the resulting polypeptide retains a specific binding affinity to a target molecule or retains signaling activity (e.g., actuator domain activity). In certain embodiments, a linker is comprised of about two to about 35 amino acids, for instance, or about four to about 20 amino acids or about eight to about 15 amino acids or about 15 to about 25 amino acids. In other embodiments, a spacer may have a particular structure, such as an antibody CH2CH3 domain, hinge domain or the like. In one embodiment, a spacer comprises the CH2 and CH3 domains of IgG1 or IgG4.

The DARIC components may further comprise one or more "hinge domains," which plays a role in positioning the domains to enable proper cell/cell contact, antigen binding and activation. A DARIC may comprises one or more hinge domains between the binding domain and the multimerization domain and/or the transmembrane domain (TM) or between the multimerization domain and the transmembrane domain. The hinge domain may be derived either from a natural, synthetic, semi-synthetic, or recombinant source. The hinge domain can include the amino acid sequence of a naturally occurring immunoglobulin hinge region or an altered immunoglobulin hinge region.

An "altered hinge region" refers to (a) a naturally occurring hinge region with up to 30% amino acid changes (e.g., up to 25%, 20%, 15%, 10%, or 5% amino acid substitutions or deletions), (b) a portion of a naturally occurring hinge region that is at least 10 amino acids (e.g., at least 12, 13, 14 or 15 amino acids) in length with up to 30% amino acid changes (e.g., up to 25%, 20%, 15%, 10%, or 5% amino acid substitutions or deletions), or (c) a portion of a naturally occurring hinge region that comprises the core hinge region (which may be 4, 5, 6, 7, 8, 9, 10, 11, 12, 13, 14, or 15, or at least 4, 5, 6, 7, 8, 9, 10, 11, 12, 13, 14, or 15 amino acids in length). In certain embodiments, one or more cysteine residues in a naturally occurring immunoglobulin hinge region may be substituted by one or more other amino acid residues (e.g., one or more serine residues). An altered immunoglobulin hinge region may alternatively or additionally have a proline residue of a wild type immunoglobulin hinge region substituted by another amino acid residue (e.g., a serine residue).

Other illustrative hinge domains suitable for use in the DARICs described herein include the hinge region derived from the extracellular regions of type 1 membrane proteins such as CD8α, CD4, CD28 and CD7, which may be wild-type hinge regions from these molecules or may be altered. In another embodiment, the hinge domain comprises a CD8α hinge region.

"Junction amino acids" or "junction amino acid residues" refer to one or more (e.g., about 2-10) amino acid residues between two adjacent motifs, regions or domains of a polypeptide, such as between a binding domain and an adjacent multimerization domain or between a hydrophobic region and an adjacent multimerization domain or between a peptide linker or spacer that links two motifs, regions or domains and an adjacent actuator domain. Junction amino acids may result from the construct design of a fusion protein (e.g., amino acid residues resulting from the use of a restriction enzyme site during the construction of a nucleic acid molecule encoding a fusion protein).

An "altered domain" or "altered protein" refers to a motif, region, domain, peptide, polypeptide, or protein with a sequence identity to a wild type motif, region, domain, peptide, polypeptide, or protein (e.g., a wild type human FKBP12, FRP, ITAM, CD3ζ, TCR) of at least 75% (e.g., 80%, 82%, 84%, 86%, 88%, 90%, 91%, 92%, 93%, 94%, 95%, 96%, 97%, 98%, 99%, or 99.5%). For example, an "altered FKBP" refers to a FKBP with a sequence identity to a wild type FKBP (e.g., a human FKBP) of at least 75% (e.g., 80%, 82%, 84%, 86%, 88%, 90%, 91%, 92%, 93%, 94%, 95%, 96%, 97%, 98%, 99%, or 99.5%). Similarly, an "altered CD3ζ" refers to a CD3ζ with a sequence identity to a wild type CD3ζ (e.g., a human CD3ζ) of at least 75% (e.g., 80%, 82%, 84%, 86%, 88%, 90%, 91%, 92%, 93%, 94%, 95%, 96%, 97%, 98%, 99%, or 99.5%).

As used herein, "nucleic acid" or "nucleic acid molecule" refers to any of deoxyribonucleic acid (DNA), ribonucleic acid (RNA), oligonucleotides, fragments generated, for example, by the polymerase chain reaction (PCR) or by in vitro translation, and fragments generated by any of ligation, scission, endonuclease action, or exonuclease action. In certain embodiments, the nucleic acids of the present disclosure are produced by PCR. Nucleic acids may be composed of monomers that are naturally occurring nucleotides (such as deoxyribonucleotides and ribonucleotides), analogs of naturally occurring nucleotides (e.g., α-enantiomeric forms of naturally-occurring nucleotides), or a combination of both. Modified nucleotides can have modifications in or replacement of sugar moieties, or pyrimidine or purine base moieties. Nucleic acid monomers can be linked by phosphodiester bonds or analogs of such linkages. Analogs of phosphodiester linkages include phosphorothioate, phosphorodithioate, phosphoroselenoate, phosphorodiselenoate, phosphoroanilothioate, phosphoranilidate, phosphoramidate, morpholino, or the like. The term "nucleic acid molecule" also includes "peptide nucleic acids" (PNAs), which comprise naturally occurring or modified nucleic acid bases attached to a polyamide backbone. Nucleic acid molecules can be either single stranded or double stranded.

As used herein, "mutation" refers to a change in the sequence of a nucleic acid molecule or polypeptide molecule as compared to a reference or wild-type nucleic acid molecule or polypeptide molecule, respectively. A mutation can result in several different types of change in sequence, including substitution, insertion or deletion of nucleotide(s) or amino acid(s). In other embodiments, a mutation is a substitution of one or more nucleotides or residues.

The term "construct" refers to any polynucleotide that contains a recombinant nucleic acid. A construct may be present in a vector (e.g., a bacterial vector, a viral vector) or may be integrated into a genome. A "vector" is a nucleic acid molecule that is capable of transporting another nucleic acid. Vectors may be, for example, plasmids, cosmids, viruses, a RNA vector or a linear or circular DNA or RNA molecule that may include chromosomal, non-chromosomal, semi-synthetic or synthetic nucleic acids. Exemplary vectors are those capable of autonomous replication (episomal vector) and/or expression of nucleic acids to which they are linked (expression vectors).

Viral vectors include retrovirus, adenovirus, parvovirus (e.g., adeno-associated viruses), coronavirus, negative strand RNA viruses such as ortho-myxovirus (e.g., influenza virus), rhabdovirus (e.g., rabies and vesicular stomatitis virus), paramyxovirus (e.g., measles and Sendai), positive strand RNA viruses such as picornavirus and alphavirus, and double-stranded DNA viruses including adenovirus, herpesvirus (e.g., Herpes Simplex virus types 1 and 2, Epstein-Barr virus, cytomegalovirus), and poxvirus (e.g., vaccinia, fowlpox and canarypox). Other viruses include Norwalk virus, togavirus, flavivirus, reoviruses, papovavirus, hepadnavirus, and hepatitis virus, for example. Examples of retroviruses include avian leukosis-sarcoma, mammalian C-type, B-type viruses, D-type viruses, HTLV-BLV group, lentivirus, spumavirus (Coffin, J. M., Retroviridae: The viruses and their replication, In Fundamental Virology, Third Edition, B. N. Fields, et al., Eds., Lippincott-Raven Publishers, Philadelphia, 1996).

"Lentiviral vector," as used herein, means HIV-based lentiviral vectors that are very promising for gene delivery because of their relatively large packaging capacity, reduced immunogenicity and their ability to stably transduce with high efficiency a large range of different cell types. Lentiviral vectors are usually generated following transient transfection of three (packaging, envelope and transfer) or more plasmids into producer cells. Like HIV, lentiviral vectors enter the target cell through the interaction of viral surface glycoproteins with receptors on the cell surface. On entry, the viral RNA undergoes reverse transcription, which is mediated by the viral reverse transcriptase complex. The product of reverse transcription is a double-stranded linear viral DNA, which is the substrate for viral integration in the DNA of infected cells.

"Integrative lentiviral vectors (or LV)," as used herein, means such vectors as examples of those that are able to integrate into the genome of a target cell.

By "non-integrative lentiviral vectors" (or NILV) is meant efficient gene delivery vectors that do not integrate into the genome of a target cell through the action of the viral integrase. In one embodiment, a NILV refers to a lentivirus having an integrase protein mutated to specifically decrease its integrase activity. Illustrative mutations in the HIV-1 pol gene suitable to reduce integrase activity include, but are not limited to: H12N, H12C, H16C, H16V, S81R, D41A, K42A, H51A, Q53C, D55V, D64E, D64V, E69A, K71A, E85A, E87A, D116N, D1161, D116A, N120G, N1201, N120E, E152G, E152A, D35E, K156E, K156A, E157A, K159E, K159A, K160A, R166A, D167A, E170A, H171A, K173A, K186Q, K186T, K188T, E198A, R199c, R199T, R199A, D202A, K211A, Q214L, Q216L, Q221L, W235F, W235E, K236S, K236A, K246A, G247W, D253A, R262A, R263A and K264H.

The term "operably-linked" refers to the association of nucleic acid sequences on a single nucleic acid fragment so that the function of one is affected by the other. For example, a promoter is operably-linked with a coding sequence when it is capable of affecting the expression of that coding sequence (i.e., the coding sequence is under the transcriptional control of the promoter). "Unlinked" means that the associated genetic elements are not closely associated with one another and the function of one does not affect the other.

As used herein, "expression vector" refers to a DNA construct containing a nucleic acid molecule that is operably-linked to a suitable control sequence capable of effecting the expression of the nucleic acid molecule in a suitable host. Such control sequences include a promoter to effect transcription, an optional operator sequence to control such transcription, a sequence encoding suitable mRNA ribosome binding sites, and sequences which control termination of transcription and translation. The vector may be a plasmid, a phage particle, a virus, or simply a potential genomic insert. Once transformed into a suitable host, the vector may replicate and function independently of the host genome, or may, in some instances, integrate into the genome itself. In the present specification, "plasmid," "expression plasmid," "virus" and "vector" are often used interchangeably.

The polynucleotides of the present invention, regardless of the length of the coding sequence itself, may be combined with other DNA sequences, such as promoters and/or enhancers, untranslated regions (UTRs), signal sequences, Kozak sequences, polyadenylation signals, additional restriction enzyme sites, multiple cloning sites, internal ribosomal entry sites (IRES), recombinase recognition sites (e.g., LoxP, FRT, and Att sites), termination codons, transcriptional termination signals, and polynucleotides encoding self-cleaving polypeptides, epitope tags, as disclosed elsewhere herein or as known in the art, such that their overall length may vary considerably. It is therefore contemplated that a polynucleotide fragment of almost any length may be employed, with the total length preferably being limited by the ease of preparation and use in the intended recombinant DNA protocol.

In particular embodiments, a vector for use in practicing the invention including, but not limited to expression vectors and viral vectors, will include exogenous, endogenous, or heterologous control sequences such as promoters and/or enhancers. An "endogenous" control sequence is one which is naturally linked with a given gene in the genome. An "exogenous" control sequence is one which is placed in juxtaposition to a gene by means of genetic manipulation (i.e., molecular biological techniques) such that transcription of that gene is directed by the linked enhancer/promoter. A "heterologous" control sequence is an exogenous sequence that is from a different species than the cell being genetically manipulated.

The term "promoter" as used herein refers to a recognition site of a polynucleotide (DNA or RNA) to which an RNA polymerase binds. An RNA polymerase initiates and transcribes polynucleotides operably linked to the promoter. In particular embodiments, promoters operative in mammalian cells comprise an AT-rich region located approximately 25 to 30 bases upstream from the site where transcription is initiated and/or another sequence found 70 to 80 bases upstream from the start of transcription, a CNCAAT region where N may be any nucleotide.

The term "enhancer" refers to a segment of DNA which contains sequences capable of providing enhanced transcription and in some instances can function independent of their orientation relative to another control sequence. An enhancer can function cooperatively or additively with promoters and/or other enhancer elements. The term "promoter/enhancer" refers to a segment of DNA which contains sequences capable of providing both promoter and enhancer functions.

Illustrative expression control sequences suitable for use in particular embodiments of the invention include, but are not limited to, a cytomegalovirus (CMV) immediate early promoter, a viral simian virus 40 (SV40) (e.g., early or late), a Moloney murine leukemia virus (MoMLV) LTR promoter, a Rous sarcoma virus (RSV) LTR, a herpes simplex virus (HSV) (thymidine kinase) promoter, H5, P7.5, and P11 promoters from vaccinia virus, an elongation factor 1-alpha (EF1a) promoter, early growth response 1 (EGR1), ferritin H (FerH), ferritin L (FerL), Glyceraldehyde 3-phosphate dehydrogenase (GAPDH), eukaryotic translation initiation factor 4A1 (EIF4A1), heat shock 70 kDa protein 5 (HSPA5), heat shock protein 90 kDa beta, member 1 (HSP90B1), heat shock protein 70 kDa (HSP70), β-kinesin (β-KIN), the human ROSA 26 locus (Irions et al., *Nature Biotechnology* 25, 1477-1482 (2007)), a Ubiquitin C promoter (UBC), a phosphoglycerate kinase-1 (PGK) promoter, a cytomegalovirus enhancer/chicken β-actin (CAG) promoter, a β-actin promoter and a myeloproliferative sarcoma virus enhancer, negative control region deleted, d1587rev primer-binding site substituted (MND) promoter (Challita et al., *J Virol.* 69(2):748-55 (1995)).

In one embodiment, a vector of the invention comprises a MND promoter.

In one embodiment, a vector of the invention comprises an EF1a promoter comprising the first intron of the human EF1a gene.

In one embodiment, a vector of the invention comprises an EF1a promoter that lacks the first intron of the human EF1a gene.

In one embodiment, a vector is a bicistronic vector comprising at least two promoters.

In a particular embodiment, a bicistronic vector comprises two or more promoters selected from the group consisting of: a CMV promoter, an SV40 promoter, an MoMLV LTR promoter, an RSV LTR, an HSV-TK promoter, H5, P7.5, and P11 promoters from vaccinia virus, an EF1a promoter, a UBC promoter, a PGK promoter, a CAG promoter, a β-actin promoter and an MND promoter.

The term "expression", as used herein, refers to the process by which a polypeptide is produced based on the nucleic acid sequence of a gene. The process includes both transcription and translation.

The term "introduced" in the context of inserting a nucleic acid sequence into a cell, means "transfection", or "transformation" or "transduction" and includes reference to the incorporation of a nucleic acid sequence into a eukaryotic or prokaryotic cell wherein the nucleic acid sequence may be incorporated into the genome of the cell (e.g., chromosome, plasmid, plastid, or mitochondrial DNA), converted into an autonomous replicon, or transiently expressed (e.g., transfected mRNA).

"Sequence identity," as used herein, refers to the percentage of amino acid residues in one sequence that are identical with the amino acid residues in another reference polypeptide sequence after aligning the sequences and introducing gaps, if necessary, to achieve the maximum percent sequence identity, and not considering any conservative substitutions as part of the sequence identity. The percentage sequence identity values are generated by the NCBI BLAST2.0 software as defined by Altschul et al. (1997) "Gapped BLAST and PSI-BLAST: a new generation of protein database search programs," Nucleic Acids Res. 25:3389-3402, with the parameters set to default values.

In certain embodiments, an altered immunoglobulin domain only contains conservative amino acid substitutions of a wild type immunoglobulin domain. In certain other embodiments, an altered immunoglobulin domain only contains non-conservative amino acid substitutions of a wild type immunoglobulin domain. In yet other embodiments, an altered immunoglobulin domain contains both conservative and non-conservative amino acid substitutions.

A "conservative substitution" is recognized in the art as a substitution of one amino acid for another amino acid that has similar properties. Exemplary conservative substitutions are well known in the art (see, e.g., WO 97/09433, page 10, published Mar. 13, 1997; Lehninger, Biochemistry, Second Edition; Worth Publishers, Inc. NY: N.Y. (1975), pp. 71-77; Lewin, Genes IV, Oxford University Press, NY and Cell Press, Cambridge, Mass. (1990), p. 8). In certain embodiments, a conservative substitution includes a leucine to serine substitution.

As used herein, the term "derivative" refers to a modification of one or more amino acid residues of a peptide by chemical or biological means, either with or without an enzyme, e.g., by glycosylation, alkylation, acylation, ester formation, or amide formation. Generally, a "derivative" differs from an "analogue" in that a parent polypeptide may be the starting material to generate a "derivative," whereas the parent polypeptide may not necessarily be used as the starting material to generate an "analogue." A derivative may have different chemical, biological or physical properties of the parent polypeptide. For example, a derivative may be more hydrophilic or it may have altered reactivity (e.g., a CDR having an amino acid change that alters its affinity for a target, or FKBP having an amino acid change that alters its affinity for rapamycin or a rapalog thereof) as compared to the parent polypeptide.

A "receptor" is a protein present in the plasma membrane or in the cytoplasm of a cell to which a signal molecule (i.e., a ligand, such as a hormone, neurotransmitter, toxin, cytokine) may bind or attach. The binding of the single molecule to the receptor may result in a conformational change of the receptor, which can initiate a cellular response. However, some ligands merely block receptors without inducing any response (e.g., antagonists). Some receptor proteins are peripheral membrane proteins, many hormone and neurotransmitter receptors are transmembrane proteins that are embedded in the phospholipid bilayer of cell membranes, and another major class of receptors are intracellular proteins such as those for steroid and intracrine peptide hormone receptors.

As used herein, the term "isolated" refers to a substance that has been removed from the source in which it naturally occurs. A substance need not be purified in order to be isolated. For example, a protein produced in a host cell is considered isolated when it is removed or released from the cell. A protein contained within a crude cell lysate fraction is considered "isolated" for purposes of the present disclosure. Further, an "isolated nucleic acid molecule" refers to a polynucleotide molecule in the form of a separate fragment or as a component of a larger nucleic acid construct, which has been separated from its source cell, including the chromosome it normally resides in, at least once. For example, a DNA molecule that encodes a recombinant polypeptide, peptide, or variant thereof, which has been separated from the genomic DNA of a cell, is an isolated nucleic acid molecule. Another example of an isolated nucleic acid molecule is a bacteriophage promoter (e.g., T5 or T7), or nucleic acid expression control sequence, which can be cloned into a vector capable of replication in a suitable host cell. Still another example of an isolated nucleic acid molecule is a chemically synthesized or PCR synthesized nucleic acid molecule.

As used herein, the term "purified" refers to a substance that has been rendered at least partially free of contaminants and other materials that typically accompany it. Substances can be purified to varying degrees. A substance is "substantially pure" when a preparation or composition of the substance contains less than about 1% contaminants. A substance is "essentially pure" when a preparation or composition of the substance contains less than about 5% contaminants. A substance is "pure" when a preparation or composition of the substance contains less than about 2% contaminants. For substances that are "purified to homogeneity," contaminants cannot be detected with conventional analytical methods.

"Treatment," "treating" or "ameliorating" refers to either a therapeutic treatment or prophylactic/preventative treatment. A treatment is therapeutic if at least one symptom of disease in an individual receiving treatment improves or a treatment may delay worsening of a progressive disease in an individual, or prevent onset of additional associated diseases.

A "therapeutically effective amount (or dose)" or "effective amount (or dose)" of a specific binding molecule or compound refers to that amount of the compound sufficient to result in amelioration of one or more symptoms of the disease being treated in a statistically significant manner. When referring to an individual active ingredient, administered alone, a therapeutically effective dose refers to that ingredient alone. When referring to a combination, a therapeutically effective dose refers to combined amounts of the active ingredients that result in the therapeutic effect, whether administered serially or simultaneously.

The term "pharmaceutically acceptable" refers to molecular entities and compositions that do not produce allergic or other serious adverse reactions when administered using routes well known in the art.

A "subject in need" refers to a subject at risk of, or suffering from, a disease, disorder or condition that is amenable to treatment or amelioration with a non-natural cell, polypeptide complex or a composition thereof provided herein. In certain embodiments, a subject is a human.

Additional definitions are provided throughout the present disclosure.

In certain aspects, the instant disclosure is directed to a non-natural cell, comprising (a) a first nucleic acid molecule encoding a first fusion protein comprising a first multimerization domain, a hydrophobic domain, and an actuator domain, wherein the first multimerization domain localizes extracellularly when the first fusion protein is expressed; and (b) a second nucleic acid molecule encoding a second fusion protein comprising a binding domain and a second multimerization domain, wherein the second fusion protein localizes extracellularly, either secreted from the cell or anchored to the cell surface, when expressed; wherein a first bridging factor promotes the formation of a polypeptide complex on the non-natural cell surface with the bridging factor associated with and disposed between the multimerization domains of the first and second fusion proteins. In certain embodiments, the second fusion protein (e.g., DARIC binding component) further comprises an anchor domain (e.g., transmembrane domain, GPI signal sequence), wherein the extracellularly localized second fusion protein is tethered or anchored to the surface of the non-natural cell. In certain embodiments, a fusion protein is anchored to the surface of a non-natural cell by a transmembrane domain, such as a transmembrane domain from CD4, CD8, CD28, CD71, CD154, AMN, or the like. In some embodiments, a fusion protein is anchored to the surface of a non-natural cell by a GPI molecule.

In particular embodiments, a non-natural cell comprises a multipartite signaling complex comprising a first fusion polypeptide that comprises a first hydrophobic domain, e.g., a transmembrane domain, and a second fusion polypeptide that comprises a second hydrophobic domain, e.g., a transmembrane domain, wherein the hydrophobic domains of the first and second fusion polypeptides do not associate or interact in such a way as to increase cytotoxic activity of the non-natural cell in the absence of the bridging factor.

In other particular embodiments, a non-natural cell comprises a multipartite signaling complex comprising a first fusion polypeptide that comprises a first hydrophobic domain, e.g., a transmembrane domain, and a second fusion polypeptide that comprises a second hydrophobic domain, e.g., a transmembrane domain, wherein the hydrophobic domains of the first and second fusion polypeptides associate or interact in such a way as to increase cytotoxic activity of the non-natural cell in the absence of the bridging factor, but wherein the increase is less than the increase in or level of cytotoxic activity of the non-natural cell in the presence of the bridging factor. In a further embodiment, a first fusion protein, rather than comprising its own hydrophobic and actuator domains, instead comprises a binding domain that binds to a transmembrane protein expressed on the surface of a T cell that comprises a hydrophobic and actuator domain (e.g., TCR/CD3 or the like).

In further aspects, the instant disclosure is directed to a first non-natural cell comprising a heterologous nucleic acid molecule encoding a first fusion protein comprising a first multimerization domain, a hydrophobic domain, and an actuator domain, wherein the first multimerization domain localizes extracellularly when the first fusion protein is expressed; and a second non-natural cell comprising a heterologous a second nucleic acid molecule encoding a second fusion protein comprising a binding domain and a second multimerization domain, wherein the second fusion protein is released extracellularly when expressed; wherein a first bridging factor promotes the formation of a polypeptide complex on the first non-natural cell surface with the bridging factor associated with and disposed between the multimerization domains of the first and second fusion proteins.

In certain embodiments, the first and second multimerization domains are the same or different. Exemplary bridging factors that associate with multimerization domains and are useful with the fusion proteins of this disclosure include rapamycin (sirolimus) or a rapalog thereof, coumermycin or a derivative thereof, gibberellin or a derivative thereof, abscisic acid (ABA) or a derivative thereof, methotrexate or a derivative thereof, cyclosporin A or a derivative thereof, FKCsA or a derivative thereof, trimethoprim (Tmp)-synthetic ligand for FKBP (SLF) or a derivative thereof, or any combination thereof.

Exemplary rapamycin analogs (rapalogs) include those disclosed in U.S. Pat. No. 6,649,595, which rapalog structures are incorporated herein by reference. In certain embodiments, a bridging factor is a rapalog with substantially reduced immunosuppressive effect as compared to rapamycin. A "substantially reduced immunosuppressive effect" refers to a rapalog having at least less than 0.1 to 0.005 times the immunosuppressive effect observed or expected for an equimolar amount of rapamycin, as measured either clinically or in an appropriate in vitro (e.g., inhibition of T cell proliferation) or in vivo surrogate of human immunosuppressive activity. Alternatively, "substantially reduced immunosuppressive effect" refers to a rapalog having an $EC_{50}$ value in such an in vitro assay that is at least 10 to 250 times larger than the $EC_{50}$ value observed for rapamycin in the same assay. Other exemplary rapalogs include everolimus, novolimus, pimecrolimus, ridaforolimus, tacrolimus, temsirolimus, umirolimus, and zotarolimus.

In certain embodiments, multimerization domains will associate with a bridging factor being a rapamycin or rapalog thereof. For example, the first and second multimerization domains are a pair selected from FKBP and FRB. FRB domains are polypeptide regions (protein "domains") that are capable of forming a tripartite complex with an FKBP protein and rapamycin or rapalog thereof. FRB domains are present in a number of naturally occurring proteins, including mTOR proteins (also referred to in the literature as FRAP, RAPT1, or RAFT) from human and other species; yeast proteins including Tor1 and Tor2; and a *Candida* FRAP homolog. Information concerning the nucleotide sequences, cloning, and other aspects of these proteins is already known in the art. For example, a protein sequence accession number for a human mTOR is GenBank Accession No. L34075.1 (Brown et al., *Nature* 369:756, 1994).

FRB domains for use in the fusion proteins of this disclosure generally contain at least about 85 to about 100 amino acid residues. In certain embodiments, an FRB amino acid sequence for use in fusion proteins of this disclosure will comprise a 93 amino acid sequence Ile-2021 through Lys-2113 and a mutation of T2098L, based the amino acid sequence of GenBank Accession No. L34075.1. A FRB domain for use in fusion proteins of this disclosure will be capable of binding to a complex of an FKBP protein bound to rapamycin or a rapalog thereof of this disclosure. In certain embodiments, a peptide sequence of an FRB domain comprises (a) a naturally occurring peptide sequence spanning at least the indicated 93 amino acid region of human mTOR or corresponding regions of homologous proteins; (b) a variant of a naturally occurring FRB in which up to about ten amino acids, or about 1 to about 5 amino acids or about 1 to about 3 amino acids, or in some embodiments just one amino acid, of the naturally-occurring peptide have been deleted, inserted, or substituted; or (c) a peptide encoded by a nucleic acid molecule capable of selectively hybridizing to a DNA molecule encoding a naturally occurring FRB domain or by a DNA sequence which would be capable, but for the degeneracy of the genetic code, of selectively hybridizing to a DNA molecule encoding a naturally occurring FRB domain.

FKBPs (FK506 binding proteins) are the cytosolic receptors for macrolides, such as FK506, FK520 and rapamycin, and are highly conserved across species lines. For the purpose of this disclosure, FKBPs are proteins or protein domains that are capable of binding to rapamycin or to a rapalog thereof and further forming a tripartite complex with an FRB-containing protein or fusion protein. An FKBP domain may also be referred to as a "rapamycin binding domain". Information concerning the nucleotide sequences, cloning, and other aspects of various FKBP species is known in the art (see, e.g., Staendart et al., *Nature* 346:671, 1990 (human FKBP12); Kay, *Biochem. J.* 314:361, 1996). Homologous FKBP proteins in other mammalian species, in yeast, and in other organisms are also known in the art and may be used in the fusion proteins disclosed herein. The size of FKBP domains for use in this invention varies, depending on which FKBP protein is employed. An FKBP domain of a fusion protein of this disclosure will be capable of binding to rapamycin or a rapalog thereof and participating in a tripartite complex with an FRB-containing protein (as may be determined by any means, direct or indirect, for detecting such binding).

The peptide sequence of an FKBP domain of an FKBP fusion protein of this invention comprises (a) a naturally occurring FKBP peptide sequence, preferably derived from the human FKBP12 protein (GenBank Accession No. AAA58476.1) or a peptide sequence derived therefrom, from another human FKBP, from a murine or other mammalian FKBP, or from some other animal, yeast or fungal FKBP; (b) a variant of a naturally occurring FKBP sequence in which up to about ten amino acids, or about 1 to about 5 amino acids or about 1 to about 3 amino acids, or in some embodiments just one amino acid, of the naturally-occurring peptide have been deleted, inserted, or substituted; or (c) a peptide sequence encoded by a nucleic acid molecule capable of selectively hybridizing to a DNA molecule encoding a naturally occurring FKBP or by a DNA sequence which would be capable, but for the degeneracy of the genetic code, of selectively hybridizing to a DNA molecule encoding a naturally occurring FKBP.

Other multimerization domain pairs include FKBP and calcineurin, FKBP and cyclophilin, FKBP and bacterial DHFR, calcineurin and cyclophilin, PYL1 and ABI1, or GIB1 and GAI, or variants thereof.

In yet other embodiments, an anti-bridging factor blocks the association of at least two first fusion proteins with the bridging factor. For example, cyclosporin or FK506 could be used as anti-bridging factors to titrate out rapamycin and, therefore, stop signaling since only one multimerization domain is bound. In certain embodiments, an anti-bridging factor (e.g., cyclosporine, FK506) is an immunosuppressive agent. For example, an immunosuppressive anti-bridging factor may be used to block or minimize the function of the fusion proteins of the instant disclosure and at the same time inhibit or block an unwanted or pathological inflammatory response in a clinical setting.

In certain embodiments, a first fusion protein (e.g., DARIC signaling component) has a first multimerization domain comprising a first FKBP polypeptide or variant thereof, and a second fusion protein (e.g., DARIC binding component) has a second multimerization domain comprising a first FRB polypeptide or variant thereof. In other embodiments, a first fusion protein (e.g., DARIC signaling component) has a first multimerization domain comprising a first FRB polypeptide or variant thereof, and a second fusion protein (e.g., DARIC binding component) has a second multimerization domain comprising a first FKBP polypeptide or variant thereof. In any of these embodiments, the second fusion protein further comprises an anchor domain (e.g., transmembrane domain, GPI signal sequence) and optionally a sub-threshold signaling domain. In some embodiments, a second fusion protein contains a GPI molecule, wherein the GPI signal sequence has been removed or altered to attach the GPI molecule.

In certain embodiments, a first nucleic acid molecule encoding a first fusion protein comprising a first multimerization domain, a third multimerization domain, a hydrophobic domain, and an actuator domain, wherein the first and third multimerization domains localize extracellularly when the first fusion protein is expressed in a cell. In certain embodiments, the third multimerization domain of the first fusion protein is a binding domain for a bridging factor selected from rapamycin or a rapalog thereof, coumermycin or a derivative thereof, gibberellin or a derivative thereof, ABA or a derivative thereof, methotrexate or a derivative thereof, cyclosporin A or a derivative thereof, FKCsA or a derivative thereof, Tmp-SLF or a derivative thereof, or any combination thereof.

In still further embodiments, a second bridging factor promotes the association of at least two first fusion proteins with the bridging factor associated with and disposed between the third multimerization domains of the first fusion proteins. In certain embodiments, a protein complex that is formed is a homocomplex comprising at least two first fusion proteins, wherein the multimerization domains may be DHFR (with the bridging molecule being methotrexate) or GyrB (with the bridging molecule being coumermycin) or FKBP (with the bridging molecule being AP1903 or AP20187). In certain other embodiments, a protein complex is a heterocomplex comprising one or more first fusion proteins and one or more second fusion proteins.

In certain embodiments, a hydrophobic domain is a transmembrane domain, such as a transmembrane domain from CD4, CD8, CD28, CD71, CD154, AMN or the like. In some embodiments, a fusion protein (e.g., DARIC binding component) comprises an anchor domain, such as a transmembrane domain or GPI signal sequence. In certain embodiments, the transmembrane domain is from CD4, CD8, CD28, CD71, CD154, AMN or the like. In further embodiments, a fusion protein (e.g., DARIC binding component) contains a GPI molecule, wherein the GPI signal sequence has been removed or altered to attach the GPI molecule.

In further embodiments, the actuator domain comprises a lymphocyte receptor signaling domain or comprises an amino acid sequences having one or a plurality of immunoreceptor tyrosine-based activation motifs (ITAMs). In still further embodiments, an actuator domain comprises a cytoplasmic portion that associates with a cytoplasmic signaling protein, wherein the cytoplasmic signaling protein is a lymphocyte receptor or signaling domain thereof, a protein comprising a plurality of immunoreceptor tyrosine-based activation motifs (ITAMs), a costimulatory domain, an adhesion factor, or any combination thereof. Exemplary actuator domains include, but are not limited to, CD2, CD3ε, CD3δ, CD3ζ, pTα, TCRα, TCRβ, FcRα, FcRβ, FcRγ, NKG2D, CD22, CD79A, and CD79B, CD27, CD28, CD30, CD40, LAT, Zap70, ICOS, DAP10, 4-1BB, CARD11, HVEM, LAG3, SLAMF1, Lck, Fyn, Slp76, TRIM, OX40, or any combination thereof. In yet further embodiments, a first nucleic acid molecule encodes the first fusion protein further comprising one or more different actuator domains, costimulatory domains, adhesion factors, or any combination thereof. As used herein, the term, "costimulatory signaling domain," or "costimulatory domain", refers to an intracellular signaling domain of a costimulatory factor. Exemplary costimulatory domains include, but are not limited to intracellular signaling domains from CD2, CD27, CD28, CD30, CD40, LAT, Zap70, ICOS, DAP10, 4-1BB, CARD11, HVEM, LAG3, SLAMF1, Lck, Fyn, Slp76, TRIM, and OX40.

In certain embodiments, a non-natural cell further overexpresses a costimulatory factor, an immunomodulatory factor, an agonist for a costimulatory factor, an agonist for an immunomodulatory factor, or any combination thereof. In a related embodiment, cofactor IL-12 is overexpressed or supplied to the cell.

Fusion protein binding domains useful in the instant invention include those known in the art or as described herein, or those generated by a variety of methods known in the art (see, e.g., U.S. Pat. Nos. 6,291,161 and 6,291,158). For example, fusion protein binding domains may be identified by screening a Fab phage library for Fab fragments that specifically bind to a target of interest (see Hoet et al., *Nat. Biotechnol.* 23:344, 2005). Additionally, traditional strategies for hybridoma development, such as using a target antigen as an immunogen in convenient systems (e.g., mice, HuMAb Mouse®, TC Mouse™, KM-mouse®, llamas, sheep, chicken, rats, hamsters, rabbits, etc.), can be used to develop anti-target antibodies having target-specific binding domains of interest.

Sources of further binding domains include target-specific antibody variable domains from various species (which can be formatted as antibodies, sFvs, scFvs, Fabs, or soluble VH domain or domain antibodies), including human, rodent, avian, and ovine. Additional sources of binding domains include variable domains of antibodies from other species, such as camelid (from camels, dromedaries, or llamas (Ghahroudi et al., *FEBS Letters* 414:521, 1997; Vincke et al., *J. Biol. Chem.* 284:3273, 2009; and Hamers-Casterman et al., *Nature* 363:446, 1993; and Nguyen et al., *J. Mol. Biol.* 275:413, 1998), nurse sharks (Roux et al., *Proc. Nat'l. Acad. Sci.* (*USA*) 95:11804, 1998), spotted ratfish (Nguyen et al., *Immunogenetics* 54:39, 2002), or lamprey (Herrin et al., *Proc. Nat'l. Acad. Sci.* (*USA*) 105:2040, 2008 and Alder et al., *Nature Immunol.* 9:319, 2008). These antibodies can apparently form antigen-binding regions using only heavy chain variable region, i.e., these functional antibodies are homodimers of heavy chains only (referred to as "heavy chain antibodies") (Jespers et al., *Nat. Biotechnol.* 22:1161, 2004; Cortez-Retamozo et al., *Cancer Res.* 64:2853, 2004; Baral et al., *Nature Med.* 12:580, 2006, and Barthelemy et al., *J. Biol. Chem.* 283:3639, 2008).

Other alternative sources of target-specific binding domains includes sequences that encode random peptide libraries or sequences that encode an engineered diversity of amino acids in loop regions of alternative non-antibody scaffolds, such as fibrinogen domains (see, e.g., Weisel et al. (1985) *Science* 230:1388), Kunitz domains (see, e.g., U.S. Pat. No. 6,423,498), ankyrin repeat proteins (also known as DARPins; Binz et al., *J. Mol. Biol.* 332:489, 2003 and Binz et al., *Nat. Biotechnol.* 22:575, 2004), fibronectin binding domains (also known as adnectins or monobodies; Richards et al., *J. Mol. Biol.* 326:1475, 2003; Parker et al., *Protein Eng. Des. Sel.* 18:435, 2005 and Hackel et al., *J. Mol. Biol.* 381:1238, 2008), cysteine-knot miniproteins (Vita et al., *Proc. Nat'l. Acad. Sci.* (*USA*) 92:6404, 1995; Martin et al., *Nat. Biotechnol.* 21:71, 2002 and Huang et al., *Structure* 13:755, 2005), tetratricopeptide repeat domains (Main et al., *Structure* 11:497, 2003 and Cortajarena et al., *ACS Chem. Biol.* 3:161, 2008), leucine-rich repeat domains (Stumpp et al., *J. Mol. Biol.* 332:471, 2003), anticalins (Skerra, *FEBS J.* 275:2677, 2008), lipocalin domains (see, e.g., PCT Publication No. WO 2006/095164, Beste et al., *Proc. Nat'l. Acad. Sci.* (*USA*) 96:1898, 1999 and Schönfeld et al., *Proc. Nat'l. Acad. Sci.* (*USA*) 106:8198, 2009), armadillo repeat proteins (ArmRPs; Varadamsetty et al., *J. Mol. Biol.* 424:68, 2012), diabodies (Manzke et al., *Int. J. Cancer* 82:700, 1999), repebodies (Lee et al., *Proc. Nat'l. Acad. Sci. U.S.A.* 109: 3299, 2012), minibodies (Hu et al., *Cancer Res.* 56:3055, 1996), cyclotides (Craik et al., *J. Mol. Biol.* 294:1327, 1999), V-like domains (see, e.g., US Patent Application Publication No. 2007/0065431), C-type lectin domains (Zelensky and Gready, *FEBS J.* 272:6179, 2005; Beavil et al. *I, Proc. Nat'l. Acad. Sci.* (*USA*) 89:753, 1992 and Sato et al., *Proc. Nat'l. Acad. Sci.* (*USA*) 100:7779, 2003), mAb$^2$ or Fcab™ (see, e.g., PCT Publication Nos. WO 2007/098934; WO 2006/072620), or the like (Nord et al., *Protein Eng.* 8:601, 1995; Nord et al., *Nat. Biotechnol.* 15:772, 1997; Nord et al., *Eur. J. Biochem.* 268:4269, 2001; and Binz et al. (2005) *Nat. Biotechnol.* 23:1257, 2005).

In certain embodiments, the binding domain of the second fusion protein is a single chain antibody variable region, a receptor ectodomain, or a ligand. In further embodiments, the single chain antibody variable region is a domain antibody, sFv, scFv, F(ab')$_2$, or Fab. In still further embodiments, the binding domain of the second fusion protein is amino or carboxy terminal to the multimerization domain.

In certain further aspects, a non-natural cell comprises a nucleic acid molecule that encodes a fusion comprising a binding domain and multimerization domain, and optionally an anchor domain (e.g., transmembrane domain, GPI signal sequence) or an anchor domain with a sub-threshold signaling domain, wherein the binding domain specifically binds to a target located on a target cell surface. In further embodiments, a binding domain is specific for a target that is an antigen associated with a cancer (e.g., solid malignancy, hematologic malignancy), an inflammatory disease, an autoimmune disease, or a graft versus host disease. Exemplary target antigens include, but are not limited to, α-folate receptor, $\alpha_v\beta_6$ integrin, BCMA, B7-H3, B7-H6, CAIX, CD19, CD20, CD22, CD30, CD33, CD37, CD44, CD44v6, CD44v7/8, CD70, CD123, CD138, CD171, CEA, DLL4, EGP-2, EGP-40, CSPG4, EGFR, EGFR family including ErbB2 (HER2), EGFRvIII, EPCAM, EphA2, EpCAM, FAP, FBP, fetal acetylcholine receptor, Fzd7, GD2, GD3, Glypican-3 (GPC3), h5T4, IL-11Rα, IL13R-α2, KDR, κ light chain, λ light chain, LeY, L1CAM, MAGE-A1, mesothelin, MHC presented peptides, MUC1, MUC16, NCAM, NKG2D ligands, Notch1, Notch2/3, NY-ESO-1, PRAME, PSCA, PSMA, Survivin, TAG-72, TEMs, TERT, VEGFR2, and ROR1.

In certain embodiments, such a binding fusion protein (DARIC binding component) forms a tripartite complex with DARIC signaling component and a bridging factor to form a polypeptide complex. Exemplary bridging factors for such a complex include rapamycin or a rapalog thereof, coumermycin or a derivative thereof, gibberellin or a derivative thereof, ABA or a derivative thereof, methotrexate or a derivative thereof, cyclosporin A or a derivative thereof, FKCsA or a derivative thereof, or Tmp-SLF or a derivative thereof.

In other embodiments, the instant disclosure is directed to a non-natural cell comprising (a) a heterologous first nucleic acid molecule encoding a first fusion protein comprising a first multimerization domain, a hydrophobic domain, and an actuator domain, wherein the first multimerization domain localizes extracellularly when the first fusion protein is expressed; and (b) a second nucleic acid molecule encoding a second fusion protein comprising a binding domain, a second multimerization domain and an anchor domain (e.g., transmembrane domain, GPI molecule), wherein the second fusion protein localizes to the cell surface when expressed; wherein a first bridging factor promotes the formation of a polypeptide complex on the non-natural cell surface with the bridging factor associated with and disposed between the multimerization domains of the first and second fusion proteins. In certain embodiments, the second fusion protein further comprises an intracellularly localized sub-threshold signaling domain.

As used herein, a "sub-threshold signaling domain" is not capable of inducing or activating a sufficiently robust signal transduction cascade in the presence of one or more other sub-threshold signaling domains, but can induce or activate a signal transduction cascade or adjust a signal qualitatively in the presence of an actuator domain. For example, a second fusion protein tethered to a cell surface that associates with another second fusion protein tethered to a cell surface will not induce or will minimally activate signal transduction. Exemplary sub-threshold signaling domains include costimulatory domains, such as CD28, CD2, CD4, CD5, CD8, CD9, CD27, CD44, CD46, CD81, CD137, LFA-1, ICAM-1, VLA-4, OX40, 4-1BB, LIGHT, SLAM, ICOS, CTLA-4, PD-1, or the like.

In particular embodiments, an encoded first fusion protein comprises a first multimerization domain of FRB T2098L, a transmembrane domain, a costimulatory domain of 4-1BB, and actuator domain of CD3ζ; wherein the second encoded fusion protein comprises a binding domain of an scFv specific for CD19 and a second multimerization domain of FKBP12, and optionally an anchor domain (e.g., transmembrane domain, GPI signal sequence) or an anchor domain with a sub-threshold signaling domain; and wherein the first bridging factor that promotes the formation of a polypeptide complex on the non-natural cell surface is rapalog AP21967. An exemplary first fusion protein has an amino acid sequence as set forth in SEQ ID NO.:15 and an exemplary second fusion protein has an amino acid sequence as set forth in SEQ ID NO.:1 or 56.

In certain embodiments, a DARIC binding component may have multiple binding domains. For example, a non-natural cell further comprises a third nucleic acid molecule encoding a third fusion protein comprising a binding domain and a second multimerization domain, optionally an anchor domain (e.g., transmembrane domain, GPI signal sequence) or an anchor domain with a sub-threshold signaling domain, wherein the third fusion protein localizes extracellularly when expressed. In related embodiments, the fusion proteins comprise a binding domain have one, two, three, or four binding domains, wherein the one, two, three, or four binding domains are specific for one target or up to four different targets.

In any of the aforementioned embodiments, a second nucleic acid molecule encoding a second (binding) fusion protein may further comprise a sequence encoding a linker, spacer or junction amino acids disposed between the binding domain and the second multimerization domain. In certain embodiments, a second nucleic acid molecule encoding a second fusion protein (e.g., DARIC binding component) further comprises an anchor domain (e.g., transmembrane domain, GPI signal sequence) and optionally a sub-threshold signaling domain. In further embodiments, a second fusion protein (e.g., DARIC binding component) contains a GPI molecule, wherein the GPI signal sequence has been removed or altered to attach the GPI molecule.

Exemplary diseases or disorders associated with excess receptor-mediated signal transduction include cancer (e.g., solid malignancy and hematologic malignancy), autoimmune or inflammatory diseases or conditions, sepsis resulting from bacterial infection, and viral infection.

In one aspect, the present disclosure provides a method for directing T cell activation, comprising administering to a subject in need thereof an effective amount of a DARIC binding component or a pharmaceutical composition thereof that specifically binds a target, such as a cell surface target that is a tumor-specific antigen or other antigen of choice at a site or cell where T cell activation is desired.

Pharmaceutically acceptable carriers for therapeutic use are also well known in the pharmaceutical art, and are described, for example, in the *Physicians Desk Reference*, 62nd edition. Oradell, N J: Medical Economics Co., 2008; Goodman & Gilman's *The Pharmacological Basis of Therapeutics*, Eleventh Edition. McGraw-Hill, 2005; *Remington: The Science and Practice of Pharmacy*, 20th Edition. Baltimore, Md.: Lippincott Williams & Wilkins, 2000; and *The Merck Index*, Fourteenth Edition. Whitehouse Station, N.J.: Merck Research Laboratories, 2006; each of which is hereby incorporated by reference in relevant parts. Exemplary pharmaceutically acceptable carriers include sterile saline and phosphate buffered saline at physiological pH. Preservatives, stabilizers, dyes and the like may be provided in the pharmaceutical composition. In addition, antioxidants and suspending agents may also be used.

Pharmaceutical compositions may also contain diluents such as buffers, antioxidants such as ascorbic acid, low molecular weight (less than about 10 residues) polypeptides, proteins, amino acids, carbohydrates (e.g., glucose, sucrose, dextrins), chelating agents (e.g., EDTA), glutathione and other stabilizers and excipients. Neutral buffered saline or saline mixed with nonspecific serum albumin are exemplary diluents.

In another aspect, the present disclosure provides a method for inhibiting growth, metastasis or metastatic growth of a malignancy (e.g., a solid malignancy or a hematologic malignancy), comprising administering to a subject in need thereof an effective amount of a cell encoding a polypeptide complex provided herein or a composition thereof.

A wide variety of cancers, including solid malignancy and hematologic malignancy, are amenable to the compositions and methods disclosed herein. Types of cancer that may be treated include adenocarcinoma of the breast, prostate, pancreas, colon and rectum; all forms of bronchogenic carcinoma of the lung (including squamous cell carcinoma, adenocarcinoma, small cell lung cancer and non-small cell lung cancer); myeloid; melanoma; hepatoma; neuroblastoma; papilloma; apudoma; choristoma; branchioma; malignant carcinoid syndrome; carcinoid heart disease; and carcinoma (e.g., Walker, basal cell, basosquamous, Brown-Pearce, ductal, Ehrlich tumor, Krebs 2, merkel cell, mucinous, non-small cell lung, oat cell, papillary, scirrhous, bronchiolar, bronchogenic, squamous cell, and transitional cell). Additional types of cancers that may be treated include: histiocytic disorders; leukemia; histiocytosis malignant; Hodgkin's disease; non-Hodgkin's lymphoma; plasmacytoma; reticuloendotheliosis; melanoma; renal cell carcinoma; chondroblastoma; chondroma; chondrosarcoma; fibroma; fibrosarcoma; giant cell tumors; histiocytoma; lipoma; liposarcoma; mesothelioma; myxoma; myxosarcoma; osteoma; osteosarcoma; chordoma; craniopharyngioma; dysgerminoma; hamartoma; mesenchymoma; mesonephroma; myosarcoma; ameloblastoma; cementoma; odontoma; teratoma; thymoma; trophoblastic tumor.

Further, the following types of cancers are also contemplated as amenable to treatment: adenoma; cholangioma; cholesteatoma; cyclindroma; cystadenocarcinoma; cystadenoma; granulosa cell tumor; gynandroblastoma; hepatoma; hidradenoma; islet cell tumor; Leydig cell tumor; papilloma; sertoli cell tumor; theca cell tumor; leimyoma; leiomyosarcoma; myoblastoma; myomma; myosarcoma; rhabdomyoma; rhabdomyosarcoma; ependymoma; ganglioneuroma; glioma; medulloblastoma; meningioma; neurilemmoma; neuroblastoma; neuroepithelioma; neurofibroma; neuroma; paraganglioma; paraganglioma nonchromaffin; and glioblastoma multiforme. The types of cancers that may be treated also include angiokeratoma; angiolymphoid hyperplasia with eosinophilia; angioma sclerosing; angiomatosis; glomangioma; hemangioendothelioma; hemangioma; hemangiopericytoma; hemangiosarcoma; lymphangioma; lymphangiomyoma; lymphangiosarcoma; pinealoma; carcinosarcoma; chondrosarcoma; cystosarcoma phyllodes; fibrosarcoma; hemangiosarcoma; leiomyosarcoma; leukosarcoma; liposarcoma; lymphangiosarcoma; myosarcoma; myxosarcoma; ovarian carcinoma; rhabdomyosarcoma; sarcoma; neoplasms; neurofibromatosis; and cervical dysplasia.

Additional exemplary cancers that are also amenable to the compositions and methods disclosed herein are B-cell cancers, including B-cell lymphomas (such as various forms of Hodgkin's disease, non-Hodgkins lymphoma (NHL) or central nervous system lymphomas), leukemias (such as acute lymphoblastic leukemia (ALL), chronic lymphocytic leukemia (CLL), Hairy cell leukemia and chronic myoblastic leukemia) and myelomas (such as multiple myeloma). Additional B cell cancers include small lymphocytic lymphoma, B-cell prolymphocytic leukemia, lymphoplasmacytic lymphoma, splenic marginal zone lymphoma, plasma cell myeloma, solitary plasmacytoma of bone, extraosseous plasmacytoma, extra-nodal marginal zone B-cell lymphoma of mucosa-associated (MALT) lymphoid tissue, nodal marginal zone B-cell lymphoma, follicular lymphoma, mantle cell lymphoma, diffuse large B-cell lymphoma, mediastinal (thymic) large B-cell lymphoma, intravascular large B-cell lymphoma, primary effusion lymphoma, Burkitt lymphoma/leukemia, B-cell proliferations of uncertain malignant potential, lymphomatoid granulomatosis, and post-transplant lymphoproliferative disorder.

In certain embodiments, cells encoding polypeptide complexes useful for inhibiting growth of a solid malignancy or metastasis or metastatic growth of a solid malignancy or a hematologic malignancy include those that specifically bind to a tumor or cancer antigen and a second target antigen on the cancer cell.

In another aspect, the present disclosure provides a method for treating an autoimmune or inflammatory disease, disorder or condition, comprising administering to a subject in need thereof an effective amount of a cell encoding a polypeptide complex provided herein or a composition thereof.

Exemplary autoimmune or inflammatory diseases, disorders or conditions that may be treated by the fusion proteins and compositions and unit dose forms thereof include inflammatory bowel disease (e.g., Crohn's disease or ulcerative colitis), diabetes mellitus (e.g., type I diabetes), dermatomyositis, polymyositis, pernicious anaemia, primary biliary cirrhosis, acute disseminated encephalomyelitis (ADEM), Addison's disease, ankylosing spondylitis, antiphospholipid antibody syndrome (APS), autoimmune hepatitis, Goodpasture's syndrome, Graves' disease, Guillain-Barré syndrome (GBS), Hashimoto's disease, idiopathic thrombocytopenic purpura, systemic lupus erythematosus, lupus nephritis, neuropsychiatric lupus, multiple sclerosis (MS), myasthenia gravis, *pemphigus vulgaris*, asthma, psoriatic arthritis, rheumatoid arthritis, Sjögren's syndrome, temporal arteritis (also known as "giant cell arteritis"), autoimmune hemolytic anemia, Bullous pemphigoid, vasculitis, coeliac disease, chronic obstructive pulmonary disease, endometriosis, Hidradenitis suppurativa, interstitial cystitis, morphea, scleroderma, narcolepsy, neuromyotonia, vitiligo, and autoimmune inner ear disease.

In certain embodiments, a method for treating a hyperproliferative, inflammatory, autoimmune, or graft-versus-host disease, comprises (a) administering a recombinant cell comprising a first and a second nucleic acid molecule, wherein the first nucleic acid molecule encodes a first fusion protein comprising a first multimerization domain, a hydrophobic domain, and an actuator domain, wherein the first multimerization domain localizes extracellularly when the first fusion protein is expressed, and the second nucleic acid molecule encodes a second fusion protein comprising a binding domain and a second multimerization domain, wherein the second fusion protein localizes extracellularly when expressed; and (c) administering a bridging factor, wherein the bridging factor promotes the formation of a polypeptide complex on the recombinant cell surface with the bridging factor associated with and disposed between the multimerization domains of the first and second fusion proteins; wherein the binding domain of the polypeptide complex specifically binds a cell surface target on a hyperproliferative disease cell to promote an immunomodulatory response and thereby treats the hyperproliferative disease.

In particular embodiments, a method for treating a hyperproliferative, inflammatory, autoimmune, or graft-versus-host disease, comprises (a) administering one or more recombinant cells comprising a first nucleic acid molecule and a second nucleic acid molecule, wherein the first nucleic acid molecule encodes a first fusion protein comprising a binding agent that binds a receptor expressed on a T cell and first multimerization domain, and the second nucleic acid molecule encodes a second fusion protein comprising a binding agent that binds a cell surface target on a hyperproliferative disease cell and a second multimerization domain, and (c) administering a bridging factor, wherein the bridging factor promotes the formation of a polypeptide complex, e.g., a BiTE, with the bridging factor associated with and disposed between the multimerization domains of the first and second fusion proteins; wherein the binding agent of the first fusion protein binds a receptor on a T cell and the binding agent of the second fusion protein binds a cell surface target on a hyperproliferative disease cell to promote an immunomodulatory response and thereby treats the hyperproliferative disease.

In other embodiments, a method for treating a hyperproliferative, inflammatory, autoimmune, or graft-versus-host disease, comprises (a) administering a non-natural cell comprising a first nucleic acid molecule encoding a first fusion protein comprising a first multimerization domain, a hydrophobic domain, and an actuator domain, wherein the first multimerization domain localizes extracellularly when the first fusion protein is expressed; (b) administering a second fusion protein comprising a binding domain and a second multimerization domain, optionally comprising an anchor domain (e.g., transmembrane domain, GPI signal sequence) or an anchor domain with a sub-threshold signaling domain; and (c) administering a bridging factor, wherein the bridging factor promotes the formation of a polypeptide heterocomplex on the recombinant cell surface with the bridging factor associated with and disposed between the multimerization domains of the first and second fusion proteins; wherein the binding domain of the polypeptide heterocomplex specifically binds a cell surface target on a hyperproliferative disease cell to promote an immunomodulatory response and thereby treats the hyperproliferative disease.

Any of the aforementioned non-natural cells, fusion proteins, bridging factors and other accessory molecules may be used in the methods of treatment of this disclosure. In certain embodiments, a method further comprises administering an agent that antagonizes or blocks an inhibitor of T cell activation, such as an agent that antagonizes or blocks a T cell ligand or a T cell receptor. In certain embodiments, an agent that antagonizes or blocks an inhibitor of T cell activation is an anti-PD1 antibody, anti-PD-L1 antibody, or an anti-CTLA4 antibody or antigen binding fragment thereof, or an engineered homing endonuclease that targets PD-1. In further embodiments, the method further comprises administering a cytokine agonist.

The cells, fusion proteins, bridging factors, other accessory molecules or compositions thereof of the present disclosure may be administered orally, topically, transdermally, parenterally, by inhalation spray, vaginally, rectally, or by intracranial injection, or any combination thereof. In certain embodiments, fusion proteins, bridging factors, or compositions thereof are administered parenterally. The term "parenteral," as used herein, includes subcutaneous injections, intravenous, intramuscular, intracisternal injection, or infusion techniques. Administration by intravascular, intravenous, intraarterial, intradermal, intramuscular, intramammary, intraperitoneal, intrathecal, retrobulbar, intrapulmonary injection and/or surgical implantation at a particular site is contemplated as well. In certain embodiments, fusion proteins, bridging factors, or compositions thereof are administered by injection, such as intravenously.

Also contemplated is the administration of recombinant cells with a bridging factor, recombinant cells with a fusion protein and a bridging factor, or compositions thereof in combination with a second agent. A second agent may be one accepted in the art as a standard treatment for a particular disease state or disorder, such as in cancer, inflammation, autoimmunity, and infection. Exemplary second agents contemplated include recombinant cells with a bridging factor, recombinant cells with a fusion protein and a bridging factor, or compositions thereof that bind to targets different from those that the primary protein complex binds, polyclonal antibodies, monoclonal antibodies, immunoglobulin-derived fusion proteins, chemotherapeutics, ionizing radiation, steroids, NSAIDs, anti-infective agents, or other active and ancillary agents, or any combination thereof.

Second agents useful in combination with recombinant cells with a bridging factor, recombinant cells with a fusion protein and a bridging factor, or compositions thereof provided herein may be steroids, NSAIDs, mTOR inhibitors (e.g., rapamycin (sirolimus), temsirolimus, deforolimus, everolimus, zotarolimus, curcumin, farnesylthiosalicylic acid), calcineurin inhibitors (e.g., cyclosporine, tacrolimus), anti-metabolites (e.g., mycophenolic acid, mycophenolate mofetil), polyclonal antibodies (e.g., anti-thymocyte globulin), monoclonal antibodies (e.g., daclizumab, basiliximab), and CTLA4-Ig fusion proteins (e.g., abatacept or belatacept).

Second agents useful for inhibiting growth of a solid malignancy, inhibiting metastasis or metastatic growth of a solid malignancy, or treating or ameliorating a hematologic malignancy include chemotherapeutic agents, ionizing radiation, and other anti-cancer drugs. Examples of chemotherapeutic agents contemplated as further therapeutic agents include alkylating agents, such as nitrogen mustards (e.g., mechlorethamine, cyclophosphamide, ifosfamide, melphalan, and chlorambucil); bifunctional chemotherapeutics (e.g., bendamustine); nitrosoureas (e.g., carmustine (BCNU), lomustine (CCNU), and semustine (methyl-CCNU)); ethyleneimines and methyl-melamines (e.g., triethylenemelamine (TEM), triethylene thiophosphoramide (thiotepa), and hexamethylmelamine (HMM, altretamine)); alkyl sulfonates (e.g., buslfan); and triazines (e.g., dacabazine (DTIC)); antimetabolites, such as folic acid analogues (e.g., methotrexate, trimetrexate, and pemetrexed (multitargeted antifolate)); pyrimidine analogues (such as 5-fluorouracil (5-FU), fluorodeoxyuridine, gemcitabine, cytosine arabinoside (AraC, cytarabine), 5-azacytidine, and 2,2'-difluorodeoxycytidine); and purine analogues (e.g, 6-mercaptopurine, 6-thioguanine, azathioprine, 2'-deoxycoformycin (pentostatin), erythrohydroxynonyladenine (EHNA), fludarabine phosphate, 2-chlorodeoxyadenosine (cladribine, 2-CdA)); Type I topoisomerase inhibitors such as camptothecin (CPT), topotecan, and irinotecan; natural products, such as epipodophylotoxins (e.g., etoposide and teniposide); and vinca alkaloids (e.g., vinblastine, vincristine, and vinorelbine); anti-tumor antibiotics such as actinomycin D, doxorubicin, and bleomycin; radiosensitizers such as 5-bromodeoxyuridine, 5-iododeoxyuridine, and bromodeoxycytidine; platinum coordination complexes such as cisplatin, carboplatin, and oxaliplatin; substituted ureas, such as hydroxyurea; and methylhydrazine derivatives such as N-methylhydrazine (MIH) and procarbazine.

Further therapeutic agents contemplated by this disclosure for treatment of autoimmune diseases are referred to as immunosuppressive agents, which act to suppress or mask the immune system of the individual being treated. Immunosuppressive agents include, for example, non-steroidal anti-inflammatory drugs (NSAIDs), analgesics, glucocorticoids, disease-modifying antirheumatic drugs (DMARDs) for the treatment of arthritis, or biologic response modifiers. Compositions in the DMARD description are also useful in the treatment of many other autoimmune diseases aside from rheumatoid arthritis.

Exemplary NSAIDs include ibuprofen, naproxen, naproxen sodium, Cox-2 inhibitors (such as Vioxx or Celebrex), and sialylates. Exemplary analgesics include acetaminophen, oxycodone, tramadol of proporxyphene hydrochloride. Exemplary glucocorticoids include cortisone, dexamethasone, hydrocortisone, methylprednisolone, prednisolone, or prednisone. Exemplary biological response modifiers include molecules directed against cell surface markers (e.g., CD4, CD5, etc.), cytokine inhibitors, such as the TNF antagonists (e.g. etanercept (Enbrel), adalimumab (Humira) and infliximab (Remicade)), chemokine inhibitors and adhesion molecule inhibitors. The biological response modifiers include monoclonal antibodies as well as recombinant forms of molecules. Exemplary DMARDs include azathioprine, cyclophosphamide, cyclosporine, methotrexate, penicillamine, leflunomide, sulfasalazine, hydroxychloroquine, Gold (oral (auranofin) and intramuscular) and minocycline.

In still further aspects, the instant disclosure provides a fusion polypeptide heterocomplex, comprising (a) a first fusion protein comprising a first multimerization domain, a hydrophobic domain, and an actuator domain; (b) a second fusion protein comprising an extracellular binding domain and second multimerization domain; and (c) a bridging factor; wherein the first fusion protein, second fusion protein, and bridging factor associate to form a polypeptide heterocomplex with the bridging factor associated with and disposed between the multimerization domains of the first and second fusion proteins. Any of the aforementioned fusion protein components and bridging factors and may be used in these embodiments.

In other aspects, the instant disclosure provides a nucleic acid molecule encoding any one or more of the aforementioned fusion proteins. Such nucleic acid molecules may be incorporated into an expression vector (e.g., lentiviral vector), wherein the first and second fusion proteins are encoded as a polycistronic message or as a single protein separated by a 2A peptide. In certain embodiments, the polycistronic message comprises an internal ribosome entry site (IRES) between the nucleotide sequences that encode the fusion proteins.

Illustrative examples of DARIC binding and signaling components are provided in SEQ ID NOs: 1-100 and below in Table 1.

TABLE 1

Exemplary DARIC Binding and Signaling Components

| SEQ ID NO. | Construct | Sequence |
|---|---|---|
| 1 | scFvCD19-FKBP protein | MGSDIQMTQTTSSLSASLGDRVTISCRASQDISKYLNWYQQKPDG TVKLLIYHTSRLHSGVPSRFSGSGSGTDYSLTISNLEQEDIATYFCQ QGNTLPYTFGGGTKLEITGSTSGSGKPGSGEGSTKGEVKLQESGP GLVAPSQSLSVTCTVSGVSLPDYGVSWIRQPPRKGLEWLGVIWGS ETTYYNSALKSRLTIIKDNSKSQVFLKMNSLQTDDTAIYYCAKHY YYGGSYAMDYWGQGTSVTVSSASGGGGSGVQVETISPGDGRTFP KRGQTCVVHYTGMLEDGKKFDSSRDRNKPFKFMLGKQEVIRGW EEGVAQMSVGQRAKLTISPDYAYGATGHPGIIPPHATLVFDVELL KLEG |
| 2 | SS-scFvCD19-FKBP mRNA | AUGCCCCUGGGCCUGCUGUGGCUGGGCCUGGCCCUGCUGGGC GCCCUGCACGCCCAGGCCGGAUCCGAUAUCCAGAUGACCCAG ACCACCAGCAGCCUGAGCGCCAGCCUGGGCGAUAGAGUGACC AUCAGCUGCAGAGCCAGCCAGGACAUCAGCAAGUACCUGAA CUGGUAUCAGCAGAAACCCGACGGCACCGUGAAGCUGCUGA UCUACCACACCAGCAGACUGCACAGCGGCGUGCCCAGCAGAU UUUCUGGCAGCGGCUCCGGCACCGACUACAGCCUGACCAUCU CCAACCUGGAACAGGAAGAUAUCGCUACCUACUUCUGUCAG CAAGGCAACACCCUGCCCUACACCUUCGGCGGAGGCACCAAG CUGGAAAUCACCGGCAGCACAAGCGGCAGCGGCAAGCCUGG AUCUGGCGAGGGAAGCACCAAGGGCGAAGUGAAACUGCAGG AAAGCGGCCCUGGACUGGUGGCCCCAAGCCAGUCUCUGAGCG UGACCUGUACCGUGUCCGGCGUGUCCCUGCCUGACUAUGGCG UGUCCUGGAUCAGACAGCCCCCCAGAAAGGGCCUGGAAUGG CUGGGAGUGAUCUGGGGCAGCGAGACAACCUACUACAACAG CGCCCUGAAGUCCCGGCUGACCAUCAUCAAGGACAACUCCAA GAGCCAGGUGUUCCUGAAGAUGAACAGCCUGCAGACCGACG ACACCGCCAUCUACUACUGCGCCAAGCACUACUACUACGGCG GCAGCUACGCCAUGGACUACUGGGGCCAGGGCACAAGCGUG ACCGUGUCCAGCGCUAGCGGCGGAGGUGGGAGCGGAGUGCA GGUGGAAACCAUCUCCCCAGGAGACGGGCGCACCUUCCCCAA GCGCGGCCAGACCUGCGUGGUGCACUACACCGGGAUGCUUG AAGAUGGAAAGAAAUUUGAUUCCUCCGGGACAGAAACAAG CCCUUUAAGUUUAUGCUAGGCAAGCAGGAGGUGAUCCGAGG CUGGGAAGAAGGGGUUGCCCAGAUGAGUGUGGGUCAGAGAG CCAAACUGACUAUAUCUCCAGAUUAUGCCUAUGGUGCCACU GGGCACCCAGGCAUCAUCCCACCACAUGCCACUCUCGUCUUC GAUGUGGAGCUUCUAAAACUGGAAGGCUGA |
| 3 | SS-scFvCD19-FKBP DNA | ATGCCCCTGGGCCTGCTGTGGCTGGGCCTGGCCCTGCTGGGCG CCCTGCACGCCCAGGCCGGATCCGATATCCAGATGACCCAGAC CACCAGCAGCCTGAGCGCCAGCCTGGGCGATAGAGTGACCAT CAGCTGCAGAGCCAGCCAGGACATCAGCAAGTACCTGAACTG GTATCAGCAGAAACCCGACGGCACCGTGAAGCTGCTGATCTAC CACACCAGCAGACTGCACAGCGGCGTGCCCAGCAGATTTTCTG GCAGCGGCTCCGGCACCGACTACAGCCTGACCATCTCCAACCT GGAACAGGAAGATATCGCTACCTACTTCTGTCAGCAAGGCAAC ACCCTGCCCTACACCTTCGGCGGAGGCACCAAGCTGGAAATCA CCGGCAGCACAAGCGGCAGCGGCAAGCCTGGATCTGGCGAGG GAAGCACCAAGGGCGAAGTGAAACTGCAGGAAAGCGGCCCTG GACTGGTGGCCCCAAGCCAGTCTCTGAGCGTGACCTGTACCGT GTCCGGCGTGTCCCTGCCTGACTATGGCGTGTCCTGGATCAGA CAGCCCCCCAGAAAGGGCCTGGAATGGCTGGGAGTGATCTGG GGCAGCGAGACAACCTACTACAACAGCGCCCTGAAGTCCCGG CTGACCATCATCAAGGACAACTCCAAGAGCCAGGTGTTCCTGA AGATGAACAGCCTGCAGACCGACGACACCGCCATCTACTACTG CGCCAAGCACTACTACTACGGCGGCAGCTACGCCATGGACTAC TGGGGCCAGGGCACAAGCGTGACCGTGTCCAGCGCTAGCGGC GGAGGTGGGAGCGGAGTGCAGGTGGAAACCATCTCCCCAGGA GACGGGCGCACCTTCCCCAAGCGCGGCCAGACCTGCGTGGTGC ACTACACCGGGATGCTTGAAGATGGAAAGAAATTTGATTCCTC CCGGGACAGAAACAAGCCCTTTAAGTTTATGCTAGGCAAGCA GGAGGTGATCCGAGGCTGGGAAGAAGGGGTTGCCCAGATGAG TGTGGGTCAGAGAGCCAAACTGACTATATCTCCAGATTATGCC TATGGTGCCACTGGGCACCCAGGCATCATCCCACCACATGCCA CTCTCGTCTTCGATGTGGAGCTTCTAAAACTGGAAGGCTGA |

TABLE 1-continued

Exemplary DARIC Binding and Signaling Components

| SEQ ID NO. | Construct | Sequence |
|---|---|---|
| 4 | scFvCD19-FKBP (F36V) protein | MGSDIQMTQTTSSLSASLGDRVTISCRASQDISKYLNWYQQKPDG TVKLLIYHTSRLHSGVPSRFSGSGSGTDYSLTISNLEQEDIATYFCQ QGNTLPYTFGGGTKLEITGSTSGSGKPGSGEGSTKGEVKLQESGP GLVAPSQSLSVTCTVSGVSLPDYGVSWIRQPPRKGLEWLGVIWGS ETTYYNSALKSRLTIIKDNSKSQVFLKMNSLQTDDTAIYYCAKHY YYGGSYAMDYWGQGTSVTVSSASGGGGSGVQVETISPDGRTFP KRGQTCVVHYTGMLEDGKKVDSSRDRNKPFKFMLGKQEVIRGW EEGVAQMSVGQRAKLTISPDYAYGATGHPGIIPPHATLVFDVELL KLEG |
| 5 | SS-scFvCD19-FKBP (F36V) mRNA | AUGCCCCUGGGCCUGCUGUGGCUGGGCCUGGCCCUGCUGGGC GCCCUGCACGCCCAGGCCGGAUCCGAUAUCCAGAUGACCCAG ACCACCAGCAGCCUGAGCGCCAGCCUGGGCGAUAGAGUGACC AUCAGCUGCAGAGCCAGCCAGGACAUCAGCAAGUACCUGAA CUGGUAUCAGCAGAAACCCGACGGCACCGUGAAGCUGCUGA UCUACCACACCAGCAGACUGCACAGCGGCGUGCCCAGCAGAU UUUCUGGCAGCGGCUCCGGCACCGACUACAGCCUGACCAUCU CCAACCUGGAACAGGAAGAUAUCGCUACCUACUUCUGUCAG CAAGGCAACACCCUGCCCUACACCUUCGGCGGAGGCACCAAG CUGGAAAUCACCGGCAGCACAAGCGGCAGCGGCAAGCCUGG AUCUGGCGAGGGAAGCACCAAGGGCGAAGUGAAACUGCAGG AAAGCGGCCCUGGACUGGUGGCCCCAAGCCAGUCUCUGAGCG UGACCUGUACCGUGUCCGGCGUGUCCCUGCCUGACUAUGGCG UGUCCUGGAUCAGACAGCCCCCCAGAAAGGGCCUGGAAUGG CUGGGAGUGAUCUGGGGCAGCGAGACAACCUACUACAACAG CGCCCUGAAGUCCCGGCUGACCAUCAUCAAGGACAACUCCAA GAGCCAGGUGUUCCUGAAGAUGAACAGCCUGCAGACCGACG ACACCGCCAUCUACUACUGCGCCAAGCACUACUACUACGGCG GCAGCUACGCCAUGGACUACUGGGGCCAGGGCACAAGCGUG ACCGUGUCCAGCGCUAGCGGCGGAGGUGGGAGCGGAGUGCA GGUGGAAACCAUCUCCCCAGGAGACGGGCGCACCUUCCCCAA GCGCGGCCAGACCUGCGUGGUGCACUACACCGGGAUGCUUG AAGAUGGAAAGAAAGUUGAUUCCUCCCGGGACAGAAACAAG CCCUUUAAGUUUAUGCUAGGCAAGCAGGAGGUGAUCCGAGG CUGGGAAGAAGGGGUUGCCCAGAUGAGUGUGGGUCAGAGAG CCAAACUGACUAUAUCUCCAGAUUAUGCCUAUGGUGCCACU GGGCACCCAGGCAUCAUCCCACCACAUGCCACUCUCGUCUUC GAUGUGGAGCUUCUAAAACUGGAAGGCUGA |
| 6 | SS-scFvCD19-FKBP (F36V) DNA | ATGCCCCTGGGCCTGCTGTGGCTGGGCCTGGCCCTGCTGGGCG CCCTGCACGCCCAGGCCGGATCCGATATCCAGATGACCCAGAC CACCAGCAGCCTGAGCGCCAGCCTGGGCGATAGAGTGACCAT CAGCTGCAGAGCCAGCCAGGACATCAGCAAGTACCTGAACTG GTATCAGCAGAAACCCGACGGCACCGTGAAGCTGCTGATCTAC CACACCAGCAGACTGCACAGCGGCGTGCCCAGCAGATTTTCTG GCAGCGGCTCCGGCACCGACTACAGCCTGACCATCTCCAACCT GGAACAGGAAGATATCGCTACCTACTTCTGTCAGCAAGGCAAC ACCCTGCCCTACACCTTCGGCGGAGGCACCAAGCTGGAAATCA CCGGCAGCACAAGCGGCAGCGGCAAGCCTGGATCTGGCGAGG GAAGCACCAAGGGCGAAGTGAAACTGCAGGAAAGCGGCCCTG GACTGGTGGCCCCAAGCCAGTCTCTGAGCGTGACCTGTACCGT GTCCGGCGTGTCCCTGCCTGACTATGGCGTGTCCTGGATCAGA CAGCCCCCCAGAAAGGGCCTGGAATGGCTGGGAGTGATCTGG GGCAGCGAGACAACCTACTACAACAGCGCCCTGAAGTCCCGG CTGACCATCATCAAGGACAACTCCAAGAGCCAGGTGTTCCTGA AGATGAACAGCCTGCAGACCGACGACACCGCCATCTACTACTG CGCCAAGCACTACTACTACGGCGGCAGCTACGCCATGGACTAC TGGGGCCAGGGCACAAGCGTGACCGTGTCCAGCGCTAGCGGC GGAGGTGGGAGCGGAGTGCAGGTGGAAACCATCTCCCCAGGA GACGGGCGCACCTTCCCCAAGCGCGGCCAGACCTGCGTGGTGC ACTACACCGGGATGCTTGAAGATGGAAAGAAAGTTGATTCCTC CCGGGACAGAAACAAGCCCTTTAAGTTTATGCTAGGCAAGCA GGAGGTGATCCGAGGCTGGGAAGAAGGGGTTGCCCAGATGAG TGTGGGTCAGAGAGCCAAACTGACTATATCTCCAGATTATGCC TATGGTGCCACTGGGCACCCAGGCATCATCCCACCACATGCCA CTCTCGTCTTCGATGTGGAGCTTCTAAAACTGGAAGGCTGA |
| 7 | scFvCD19-FRB (T2098L) protein | MGSDIQMTQTTSSLSASLGDRVTISCRASQDISKYLNWYQQKPDG TVKLLIYHTSRLHSGVPSRFSGSGSGTDYSLTISNLEQEDIATYFCQ QGNTLPYTFGGGTKLEITGSTSGSGKPGSGEGSTKGEVKLQESGP GLVAPSQSLSVTCTVSGVSLPDYGVSWIRQPPRKGLEWLGVIWGS ETTYYNSALKSRLTIIKDNSKSQVFLKMNSLQTDDTAIYYCAKHY YYGGSYAMDYWGQGTSVTVSSASGGGGSILWHEMWHEGLEEA SRLYFGERNVKGMFEVLEPLHAMMERGPQTLKETSFNQAYGRDL MEAQEWCRKYMKSGNVKDLLQAWDLYYHVFRRISKG |

TABLE 1-continued

Exemplary DARIC Binding and Signaling Components

| SEQ ID NO. | Construct | Sequence |
|---|---|---|
| 8 | SS-scFvCD19-FRB (T2098L) mRNA | AUGCCCCUGGGCCUGCUGUGGCUGGGCCUGGCCCUGCUGGGC GCCCUGCACGCCCAGGCCGGAUCCGAUAUCCAGAUGACCCAG ACCACCAGCAGCCUGAGCGCCAGCCUGGGCGAUAGAGUGACC AUCAGCUGCAGAGCCAGCCAGGACAUCAGCAAGUACCUGAA CUGGUAUCAGCAGAAACCCGACGGCACCGUGAAGCUGCUGA UCUACCACACCAGCAGACUGCACAGCGGCGUGCCCAGCAGAU UUUCUGGCAGCGGCUCCGGCACCGACUACAGCCUGACCAUCU CCAACCUGGAACAGGAAGAUAUCGCUACCUACUUCUGUCAG CAAGGCAACACCCUGCCCUACACCUUCGGCGGAGGCACCAAG CUGGAAAUCACCGGCAGCACAAGCGGCAGCGGCAAGCCUGG AUCUGGCGAGGGAAGCACCAAGGGCGAAGUGAAACUGCAGG AAAGCGGCCCUGGACUGGUGGCCCCAAGCCAGUCUCUGAGCG UGACCUGUACCGUGUCCGGCGUGUCCCUGCCUGACUAUGGCG UGUCCUGGAUCAGACAGCCCCCCAGAAAGGGCCUGGAAUGG CUGGGAGUGAUCUGGGGCAGCGAGACAACCUACUACAACAG CGCCCUGAAGUCCCGGCUGACCAUCAUCAAGGACAACUCCAA GAGCCAGGUGUUCCUGAAGAUGAACAGCCUGCAGACCGACG ACACCGCCAUCUACUACUGCGCCAAGCACUACUACUACGGCG GCAGCUACGCCAUGGACUACUGGGGCCAGGGCACAAGCGUG ACCGUGUCCAGCGCUAGCGGCGAGGUGGGAGCAUCCUCUG GCAUGAGAUGUGGCAUGAAGGCCUGGAAGAGGCAUCUCGUU UGUACUUUGGGGAAAGGAACGUGAAAGGCAUGUUUGAGGUG CUGGAGCCCUUGCAUGCUAUGAUGGAACGGGGCCCCCAGAC UCUGAAGGAAACAUCCUUUAAUCAGGCCUAUGGUCGAGAUU UAAUGGAGGCCCAAGAGUGGUGCAGGAAGUACAUGAAAUCA GGGAAUGUCAAGGACCUCCUCCAAGCCUGGGACCUCUAUUA UCAUGUGUUCCGACGAAUCUCAAAGGGCUGA |
| 9 | SS-scFvCD19-FRB (T2098L) DNA | ATGCCCCTGGGCCTGCTGTGGCTGGGCCTGGCCCTGCTGGGCG CCCTGCACGCCCAGGCCGGATCCGATATCCAGATGACCCAGAC CACCAGCAGCCTGAGCGCCAGCCTGGGCGATAGAGTGACCAT CAGCTGCAGAGCCAGCCAGGACATCAGCAAGTACCTGAACTG GTATCAGCAGAAACCCGACGGCACCGTGAAGCTGCTGATCTAC CACACCAGCAGACTGCACAGCGGCGTGCCCAGCAGATTTTCTG GCAGCGGCTCCGGCACCGACTACAGCCTGACCATCTCCAACCT GGAACAGGAAGATATCGCTACCTACTTCTGTCAGCAAGGCAAC ACCCTGCCCTACACCTTCGGCGGAGGCACCAAGCTGGAAATCA CCGGCAGCACAAGCGGCAGCGGCAAGCCTGGATCTGGCGAGG GAAGCACCAAGGGCGAAGTGAAACTGCAGGAAAGCGGCCCTG GACTGGTGGCCCCAAGCCAGTCTCTGAGCGTGACCTGTACCGT GTCCGGCGTGTCCCTGCCTGACTATGGCGTGTCCTGGATCAGA CAGCCCCCCAGAAAGGGCCTGGAATGGCTGGGAGTGATCTGG GGCAGCGAGACAACCTACTACAACAGCGCCCTGAAGTCCCGG CTGACCATCATCAAGGACAACTCCAAGAGCCAGGTGTTCCTGA AGATGAACAGCCTGCAGACCGACGACACCGCCATCTACTACTG CGCCAAGCACTACTACTACGGCGGCAGCTACGCCATGGACTAC TGGGGCCAGGGCACAAGCGTGACCGTGTCCAGCGCTAGCGGC GGAGGTGGGAGCATCCTCTGGCATGAGATGTGGCATGAAGGC CTGGAAGAGGCATCTCGTTTGTACTTTGGGGAAAGGAACGTGA AAGGCATGTTTGAGGTGCTGGAGCCCTTGCATGCTATGATGGA ACGGGGCCCCCAGACTCTGAAGGAAACATCCTTTAATCAGGCC TATGGTCGAGATTTAATGGAGGCCCAAGAGTGGTGCAGGAAG TACATGAAATCAGGGAATGTCAAGGACCTCCTCCAAGCCTGGG ACCTCTATTATCATGTGTTCCGACGAATCTCAAAGGGCTGA |
| 13 | scFvCD19-TM-41BB-CD3z-BFP mRNA | AUGGCUCUGCCUGUGACAGCUCUGCUGCUGCCUCUGGCCCUG CUGCUCCAUGCCGCCAGACCCGGAUCCGAUAUCCAGAUGACC CAGACCACCAGCAGCCUGAGCGCCAGCCUGGGCGAUAGAGUG ACCAUCAGCUGCAGAGCCAGCCAGGACAUCAGCAAGUACCUG AACUGGUAUCAGCAGAAACCCGACGGCACCGUGAAGCUGCU GAUCUACCACACCAGCAGACUGCACAGCGGCGUGCCCAGCAG AUUUUCUGGCAGCGGCUCCGGCACCGACUACAGCCUGACCAU CUCCAACCUGGAACAGGAAGAUAUCGCUACCUACUUCUGUC AGCAAGGCAACACCCUGCCCUACACCUUCGGCGGAGGCACCA AGCUGGAAAUCACCGGCAGCACAAGCGGCAGCGGCAAGCCU GGAUCUGGCGAGGGAAGCACCAAGGGCGAAGUGAAACUGCA GGAAAGCGGCCCUGGACUGGUGGCCCCAAGCCAGUCUCUGA GCGUGACCUGUACCGUGUCCGGCGUGUCCCUGCCUGACUAUG GCGUGUCCUGGAUCAGACAGCCCCCAGAAAGGGCCUGGAA UGGCUGGGAGUGAUCUGGGGCAGCGAGACAACCUACUACAA CAGCGCCCUGAAGUCCCGGCUGACCAUCAUCAAGGACAACUC CAAGAGCCAGGUGUUCCUGAAGAUGAACAGCCUGCAGACCG ACGACACCGCCAUCUACUACUGCGCCAAGCACUACUACUACG GCGGCAGCUACGCCAUGGACUACUGGGGCCAGGGCACAAGC |

TABLE 1-continued

Exemplary DARIC Binding and Signaling Components

| SEQ ID NO. | Construct | Sequence |
|---|---|---|
| | | GUGACCGUGUCCAGCGCUAGCGCCAAGCCUACCACCACCCCU<br>GCCCCUAGACCUCCAACACCCGCCCCAACAAUCGCCAGCCAG<br>CCUCUGUCUCUGAGGCCCGAGGCUUGUAGACCAGCUGCUGGC<br>GGAGCCGUGCACACCAGAGGACUGGAUUUCGCCUGCGACAU<br>CUACAUCUGGGCCCCUCUGGCCGGCACAUGUGGCGUGCUGCU<br>GCUGAGCCUCGUGAUCACCAUGCAUAAACGGGGCAGAAAGA<br>AACUCCUGUAUAUAUUCAAACAACCAUUUAUGAGACCAGUA<br>CAAACUACUCAAGAGGAAGAUGGCUGUAGCUGCCGAUUUCC<br>AGAAGAAGAAGAAGGAGGAUGUGAACUGCGGGUGAAGUUCA<br>GCAGAAGCGCCGACGCCCCUGCCUACCAGCAGGGCCAGAAUC<br>AGCUGUACAACGAGCUGAACCUGGGCAGAAGGGAAGAGUAC<br>GACGUCCUGGAUAAGCGGAGAGGCCGGGACCCUGAGAUGGG<br>CGGCAAGCCUCGGCGGAAGAACCCCCAGGAAGGCCUGUAUA<br>ACGAACUGCAGAAAGACAAGAUGGCCGAGGCCUACAGCGAG<br>AUCGGCAUGAAGGGCGAGCGGAGGCGGGGCAAGGGCCACGA<br>CGGCCUGUAUCAGGGCCUGUCCACCGCCACCAAGGAUACCUA<br>CGACGCCCUGCACAUGCAGGCCCUGCCCCCAAGGGGCGGCCG<br>CUCCGGUGAGGGCAGAGGAAGUCUUCUAACAUGCGGUGACG<br>UGGAGGAGAAUCCGGCCCCUCUAGAAGCGAGCUGAUUAAG<br>GAGAACAUGCACAUGAAGCUGUACAUGGAGGGCACCGUGGA<br>CAACCAUCACUUCAAGUGCACAUCCGAGGGCGAAGGCAAGCC<br>CUACGAGGGCACCCAGACCAUGAGAAUCAAGGUGGUCGAGG<br>GCGGCCCUCUCCCCUUCGCCUUCGACAUCCUGGCUACUAGCU<br>UCCUCUACGGCAGCAAGACCUUCAUCAACCACACCCAGGGCA<br>UCCCCGACUUCUUCAAGCAGUCCUUCCCUGAGGGCUUCACAU<br>GGGAGAGAGUCACCACAUACGAAGACGGGGCGUGCUGACC<br>GCUACCCAGGACACCAGCCUCCAGGACGGCUGCCUCAUCUAC<br>AACGUCAAGAUCAGAGGGGUGAACUUCACAUCCAACGGCCC<br>UGUGAUGCAGAAGAAAACACUCGGCUGGGAGGCCUUCACCG<br>AGACGCUGUACCCCGCUGACGGCGGCCUGGAAGGCAGAAAC<br>GACAUGGCCCUGAAGCUCGUGGGCGGGAGCCAUCUGAUCGC<br>AAACAUCAAGACCACAUAUGAUCCAAGAAACCCGCUAAGA<br>ACCUCAAGAUGCCUGGCGUCUACUAUGUGGACUACAGACUG<br>GAAAGAAUCAAGGAGGCCAACAACGAGACCUACGUCGAGCA<br>GCACGAGGUGGCAGUGGCCAGAUACUGCGACCUCCCUAGCA<br>AACUGGGGCACAAGCUUAAUUGA |
| 15 | FRB (T2098L)-TM-<br>41BB-CD3z protein | MGSILWHEMWHEGLEEASRLYFGERNVKGMFEVLEPLHAMMER<br>GPQTLKETSFNQAYGRDLMEAQEWCRKYMKSGNVKDLLQAWD<br>LYYHVFRRISKASAKPTTTPAPRPPTPAPTIASQPLSLRPEACRPAA<br>GGAVHTRGLDFACDIYIWAPLAGTCGVLLLSLVITMHKRGRKKL<br>LYIFKQPFMRPVQTTQEEDGCSCRFPEEEEGGCELRVKFSRSADAP<br>AYQQGQNQLYNELNLGRREEYDVLDKRRGRDPEMGGKPRRKNP<br>QEGLYNELQKDKMAEAYSEIGMKGERRRGKGHDGLYQGLSTAT<br>KDTYDALHMQALPPRG |
| 16 | SS-FRB (T2098L)-TM-<br>41BB-CD3z mRNA | AUGGCUCUGCCUGUGACAGCUCUGCUGCUGCCUCUGGCCCUG<br>CUGCUCCAUGCCGCCAGACCCGGAUCCAUCCUCUGGCAUGAG<br>AUGUGGCAUGAAGGCCUGGAAGAGGCAUCUCGUUUGUACUU<br>UGGGGAAAGGAACGUGAAAGGCAUGUUUGAGGUGCUGGAGC<br>CCUUGCAUGCUAUGAUGGAACGGGGCCCCCAGACUCUGAAG<br>GAAACAUCCUUUAAUCAGGCCUAUGGUCGAGAUUUAAUGGA<br>GGCCCAAGAGUGGUGCAGGAAGUACAUGAAAUCAGGGAAUG<br>UCAAGGACCUCCUCCAAGCCUGGGACCUCUAUUAUCAUGUG<br>UUCCGACGAAUCUCAAAGGCUAGCGCCAAGCCUACCACCACC<br>CCUGCCCCUAGACCUCCAACACCCGCCCCAACAAUCGCCAGC<br>CAGCCUCUGUCUCUGAGGCCCGAGGCUUGUAGACCAGCUGCU<br>GGCGGAGCCGUGCACACCAGAGGACUGGAUUUCGCCUGCGA<br>CAUCUACAUCUGGGCCCCUCUGGCCGGCACAUGUGGCGUGCU<br>GCUGCUGAGCCUCGUGAUCACCAUGCAUAAACGGGGCAGAA<br>AGAAACUCCUGUAUAUAUUCAAACAACCAUUUAUGAGACCA<br>GUACAAACUACUCAAGAGGAAGAUGGCUGUAGCUGCCGAUU<br>UCCAGAAGAAGAAGAAGGAGGAUGUGAACUGCGGGUGAAGU<br>UCAGCAGAAGCGCCGACGCCCCUGCCUACCAGCAGGGCCAGA<br>AUCAGCUGUACAACGAGCUGAACCUGGGCAGAAGGGAAGAG<br>UACGACGUCCUGGAUAAGCGGAGAGGCCGGGACCCUGAGAU<br>GGGCGGCAAGCCUCGGCGGAAGAACCCCCAGGAAGGCCUGU<br>AUAACGAACUGCAGAAAGACAAGAUGGCCGAGGCCUACAGC<br>GAGAUCGGCAUGAAGGGCGAGCGGAGGCGGGGCAAGGGCCA<br>CGACGGCCUGUAUCAGGGCCUGUCCACCGCCACCAAGGAUAC<br>CUACGACGCCCUGCACAUGCAGGCCCUGCCCCCAAGGGGC |
| 17 | SS-FRB (T2098L)-TM-<br>41BB-CD3z DNA | ATGGCTCTGCCTGTGACAGCTCTGCTGCTGCCTCTGGCCCTGCT<br>GCTCCATGCCGCCAGACCCGGATCCATCCTCTGGCATGAGATG<br>TGGCATGAAGGCCTGGAAGAGGCATCTCGTTTGTACTTTGGGG |

TABLE 1-continued

Exemplary DARIC Binding and Signaling Components

| SEQ ID NO. | Construct | Sequence |
|---|---|---|
| | | AAAGGAACGTGAAAGGCATGTTTGAGGTGCTGGAGCCCTTGC<br>ATGCTATGATGGAACGGGGCCCCCAGACTCTGAAGGAAACAT<br>CCTTTAATCAGGCCTATGGTCGAGATTTAATGGAGGCCCAAGA<br>GTGGTGCAGGAAGTACATGAAATCAGGGAATGTCAAGGACCT<br>CCTCCAAGCCTGGGACCTCTATTATCATGTGTTCCGACGAATCT<br>CAAAGGCTAGCGCCAAGCCTACCACCACCCCTGCCCCTAGACC<br>TCCAACACCCGCCCCAACAATCGCCAGCCAGCCTCTGTCTCTG<br>AGGCCCGAGGCTTGTAGACCAGCTGCTGGCGGAGCCGTGCAC<br>ACCAGAGGACTGGATTTCGCCTGCGACATCTACATCTGGGCCC<br>CTCTGGCCGGCACATGTGGCGTGCTGCTGCTGAGCCTCGTGAT<br>CACCATGCATAAACGGGGCAGAAAGAAACTCCTGTATATATTC<br>AAACAACCATTTATGAGACCAGTACAAACTACTCAAGAGGAA<br>GATGGCTGTAGCTGCCGATTTCCAGAAGAAGAAGAAGGAGGA<br>TGTGAACTGCGGGTGAAGTTCAGCAGAAGCGCCGACGCCCCT<br>GCCTACCAGCAGGGCCAGAATCAGCTGTACAACGAGCTGAAC<br>CTGGGCGAGAAGGGAAGAGTACGACGTCCTGGATAAGCGGAGA<br>GGCCGGGACCCTGAGATGGGCGGCAAGCCTCGGCGGAAGAAC<br>CCCCAGGAAGGCCTGTATAACGAACTGCAGAAAGACAAGATG<br>GCCGAGGCCTACAGCGAGATCGGCATGAAGGGCGAGCGGAGG<br>CGGGGCAAGGGCCACGACGGCCTGTATCAGGGCCTGTCCACC<br>GCCACCAAGGATACCTACGACGCCCTGCACATGCAGGCCCTGC<br>CCCCAAGGGGC |
| 18 | SS-FRB (T2098L)-<br>spacer-TM-41BB-CD3z<br>DNA | ATGGCTCTGCCTGTGACAGCTCTGCTGCTGCCTCTGGCCCTGCT<br>GCTCCATGCCGCCAGACCCGGATCCATCCTCTGGCATGAGATG<br>TGGCATGAAGGCCTGGAAGAGGCATCTCGTTTGTACTTTGGGG<br>AAAGGAACGTGAAAGGCATGTTTGAGGTGCTGGAGCCCTTGC<br>ATGCTATGATGGAACGGGGCCCCCAGACTCTGAAGGAAACAT<br>CCTTTAATCAGGCCTATGGTCGAGATTTAATGGAGGCCCAAGA<br>GTGGTGCAGGAAGTACATGAAATCAGGGAATGTCAAGGACCT<br>CCTCCAAGCCTGGGACCTCTATTATCATGTGTTCCGACGAATCT<br>CAAAGGCTAGCGAGAGCAAGTACGGACCGCCTGCCCACCTT<br>GCCCTGCCCCCGAGTTCCTGGGCGGACCCAGCGTGTTCCTGTT<br>CCCACCCAAGCCCAAGGACACCCTGATGATCAGCCGGACCCCC<br>GAGGTGACCTGCGTGGTGGTGGACGTGAGCCAGGAAGATCCC<br>GAGGTCCAGTTCAATTGGTACGTGGACGGCGTGGAAGTGCAC<br>AACGCCAAGACCAAGCCCAGAGAGGAACAGTTCAACAGCACC<br>TACCGGGTGGTGTCTGTGCTGACCGTGCTGCACCAGGACTGGC<br>TGAACGGCAAAGAATACAAGTGCAAGGTGTCCAACAAGGGCC<br>TGCCCAGCAGCATCGAAAAGACCATCAGCAAGGCCAAGGGCC<br>AGCCTCGCGAGCCCCAGGTGTACACCCTGCCTCCCTCCCAGGA<br>AGAGATGACCAAGAACCAGGTGTCCCTGACCTGCCTGGTGAA<br>GGGCTTCTACCCCAGCGACATCGCCGTGGAGTGGGAGAGCAA<br>CGGCCAGCCTGAGAACAACTACAAGACCACCCCTCCCGTGCTG<br>GACAGCGACGGCAGCTTCTTCCTGTACAGCCGGCTGACCGTGG<br>ACAAGAGCCGGTGGCAGGAAGGCAACGTCTTTAGCTGCAGCG<br>TGATGCACGAGGCCCTGCACAACCACTACACCCAGAAGAGCC<br>TGAGCCTGTCCCTGGGCAAGATGCATAAACGGGGCAGAAAGA<br>AACTCCTGTATATATTCAAACAACCATTTATGAGACCAGTACA<br>AACTACTCAAGAGGAAGATGGCTGTAGCTGCCGATTTCCAGAA<br>GAAGAAGAAGGAGGATGTGAACTGCGGGTGAAGTTCAGCAGA<br>AGCGCCGACGCCCCTGCCTACCAGCAGGGCCAGAATCAGCTGT<br>ACAACGAGCTGAACCTGGGCAGAAGGGAAGAGTACGACGTCC<br>TGGATAAGCGGAGAGGCCGGGACCCTGAGATGGGCGGCAAGC<br>CTCGGCGGAAGAACCCCCAGGAAGGCCTGTATAACGAACTGC<br>AGAAAGACAAGATGGCCGAGGCCTACAGCGAGATCGGCATGA<br>AGGGCGAGCGGAGGCGGGGCAAGGGCCACGACGGCCTGTATC<br>AGGGCCTGTCCACCGCCACCAAGGATACCTACGACGCCCTGCA<br>CATGCAGGCCCTGCCCCCAAGGGGC |
| 19 | FKBP (F36V)-TM-<br>41BB-CD3z protein | MGSGVQVETISPGDGRTFPKRGQTCVVHYTGMLEDGKKVDSSRD<br>RNKPFKFMLGKQEVIRGWEEGVAQMSVGQRAKLTISPDYAYGA<br>TGHPGIIPPHATLVFDVELLKLEASAKPTTTPAPRPPTPAPTIASQPL<br>SLRPEACRPAAGGAVHTRGLDFACDIYIWAPLAGTCGVLLLSLVI<br>TMHKRGRKKLLYIFKQPFMRPVQTTQEEDGCSCRFPEEEEGGCEL<br>RVKFSRSADAPAYQQGQNQLYNELNLGRREEYDVLDKRRGRDP<br>EMGGKPRRKNPQEGLYNELQKDKMAEAYSEIGMKGERRRGKGH<br>DGLYQGLSTATKDTYDALHMQALPPRG |
| 20 | SS-FKBP (F36V)-TM-<br>41BB-CD3z mRNA | AUGGCUCUGCCUGUGACAGCUCUGCUGCUGCCUCUGGCCCUG<br>CUGCUCCAUGCCGCCAGACCCGGAUCCGGAGUGCAGGUGGAA<br>ACCAUCUCCCCAGGAGACGGGCGCACCUUCCCCAAGCGCGGC<br>CAGACCUGCGUGGUGCACUACACCGGGAUGCUUGAAGAUGG<br>AAAGAAAGUUGAUUCCUCCCGGGACAGAAACAAGCCCUUUA<br>AGUUUAUGCUAGGCAAGCAGGAGGUGAUCCGAGGCUGGGAA |

TABLE 1-continued

Exemplary DARIC Binding and Signaling Components

| SEQ ID NO. | Construct | Sequence |
|---|---|---|
| | | GAAGGGGUUGCCCAGAUGAGUGUGGGUCAGAGAGCCAAACU GACUAUAUCUCCAGAUUAUGCCUAUGGUGCCACUGGGCACC CAGGCAUCAUCCCACCACAUGCCACUCUCGUCUUCGAUGUGG AGCUUCUAAAACUGGAAGCUAGCGCCAAGCCUACCACCACCC CUGCCCCUAGACCUCCAACACCCGCCCCAACAAUCGCCAGCC AGCCUCUGUCUCUGAGGCCCGAGGCUUGUAGACCAGCUGCU GGCGGAGCCGUGCACACCAGAGGACUGGAUUUCGCCUGCGA CAUCUACAUCUGGGCCCCUCUGGCCGGCACAUGUGGCGUGCU GCUGCUGAGCCUCGUGAUCACCAUGCAUAAACGGGGCAGAA AGAAACUCCUGUAUAUAUUCAAACAACCAUUUAUGAGACCA GUACAAACUACUCAAGAGGAAGAUGGCUGUAGCUGCCGAUU UCCAGAAGAAGAAGAAGGAGGAUGUGAACUGCGGGUGAAGU UCAGCAGAAGCGCCGACGCCCCUGCCUACCAGCAGGGCCAGA AUCAGCUGUACAACGAGCUGAACCUGGGCAGAAGGGAAGAG UACGACGUCCUGGAUAAGCGGAGAGGCCGGGACCCUGAGAU GGGCGGCAAGCCUCGGCGGAAGAACCCCCAGGAAGGCCUGU AUAACGAACUGCAGAAAGACAAGAUGGCCGAGGCCUACAGC GAGAUCGGCAUGAAGGGCGAGCGGAGGCGGGGCAAGGGCCA CGACGGCCUGUAUCAGGGCCUGUCCACCGCCACCAAGGAUAC CUACGACGCCCUGCACAUGCAGGCCCUGCCCCCAAGGGGC |
| 21 | SS-FKBP(F36V)-TM-41BB-CD3z DNA | ATGGCTCTGCCTGTGACAGCTCTGCTGCTGCCTCTGGCCCTGCT GCTCCATGCCGCCAGACCCGGATCCGGAGTGCAGGTGGAAAC CATCTCCCCAGGAGACGGGCGCACCTTCCCCAAGCGCGGCCAG ACCTGCGTGGTGCACTACACCGGGATGCTTGAAGATGGAAAG AAAGTTGATTCCTCCCGGGACAGAAACAAGCCCTTTAAGTTTA TGCTAGGCAAGCAGGAGGTGATCCGAGGCTGGGAAGAAGGGG TTGCCCAGATGAGTGTGGGTCAGAGAGCCAAACTGACTATATC TCCAGATTATGCCTATGGTGCCACTGGGCACCCAGGCATCATC CCACCACATGCCACTCTCGTCTTCGATGTGGAGCTTCTAAAAC TGGAAGCTAGCGCCAAGCCTACCACCACCCCTGCCCCTAGACC TCCAACACCCGCCCCAACAATCGCCAGCCAGCTCTGTCTCTG AGGCCCGAGGCTTGTAGACCAGCTGCTGGCGGAGCCGTGCAC ACCAGAGGACTGGATTTCGCCTGCGACATCTACATCTGGGCCC CTCTGGCCGGCACATGTGGCGTGCTGCTGCTGAGCCTCGTGAT CACCATGCATAAACGGGGCAGAAAGAAACTCCTGTATATATTC AAACAACCATTTATGAGACCAGTACAAACTACTCAAGAGGAA GATGGCTGTAGCTGCCGATTTCCAGAAGAAGAAGAAGGAGGA TGTGAACTGCGGGTGAAGTTCAGCAGAAGCGCCGACGCCCCT GCCTACCAGCAGGGCCAGAATCAGCTGTACAACGAGCTGAAC CTGGGCAGAAGGGAAGAGTACGACGTCCTGGATAAGCGGAGA GGCCGGGACCCTGAGATGGGCGGCAAGCCTCGGCGGAAGAAC CCCCAGGAAGGCCTGTATAACGAACTGCAGAAAGACAAGATG GCCGAGGCCTACAGCGAGATCGGCATGAAGGGCGAGCGGAGG CGGGGCAAGGGCCACGACGGCCTGTATCAGGGCCTGTCCACC GCCACCAAGGATACCTACGACGCCCTGCACATGCAGGCCCTGC CCCCAAGGGGC |
| 22 | SS-FKBP(F36V)-spacer-TM-41BB-CD3z DNA | ATGGCTCTGCCTGTGACAGCTCTGCTGCTGCCTCTGGCCCTGCT GCTCCATGCCGCCAGACCCGGATCCGGAGTGCAGGTGGAAAC CATCTCCCCAGGAGACGGGCGCACCTTCCCCAAGCGCGGCCAG ACCTGCGTGGTGCACTACACCGGGATGCTTGAAGATGGAAAG AAAGTTGATTCCTCCCGGGACAGAAACAAGCCCTTTAAGTTTA TGCTAGGCAAGCAGGAGGTGATCCGAGGCTGGGAAGAAGGGG TTGCCCAGATGAGTGTGGGTCAGAGAGCCAAACTGACTATATC TCCAGATTATGCCTATGGTGCCACTGGGCACCCAGGCATCATC CCACCACATGCCACTCTCGTCTTCGATGTGGAGCTTCTAAAAC TGGAAGCTAGCGAGAGCAAGTACGGACCGCCCTGCCCACCTT GCCCTGCCCCCGAGTTCCTGGGCGGACCCAGCGTGTTCCTGTT CCCACCCAAGCCCAAGGACACCCTGATGATCAGCCGGACCCCC GAGGTGACCTGCGTGGTGGTGGACGTGAGCCAGGAAGATCCC GAGGTCCAGTTCAATTGGTACGTGGACGGCGTGGAAGTGCAC AACGCCAAGACCAAGCCCAGAGAGGAACAGTTCAACAGCACC TACCGGGTGGTGTCTGTGCTGACCGTGCTGCACCAGGACTGGC TGAACGGCAAGAATACAAGTGCAAGGTGTCCAACAAGGGCC TGCCCAGCAGCATCGAAAAGACCATCAGCAAGGCCAAGGGCC AGCCTCGCGAGCCCCAGGTGTACACCCTGCCTCCCTCCCAGGA AGAGATGACCAAGAACCAGGTGTCCCTGACCTGCCTGGTGAA GGGCTTCTACCCCAGCGACATCGCCGTGGAGTGGGAGAGCAA CGGCCAGCCTGAGAACAACTACAAGACCACCCCTCCCGTGCTG GACAGCGACGGCAGCTTCTTCCTGTACAGCCGGCTGACCGTGG ACAAGAGCCGGTGGCAGGAAGGCAACGTCTTTAGCTGCAGCG TGATGCACGAGGCCCTGCACAACCACTACACCCAGAAGAGCC TGAGCCTGTCCCTGGGCAAGATGCATAAACGGGGCAGAAAGA AACTCCTGTATATATTCAAACAACCATTTATGAGACCAGTACA |

TABLE 1-continued

Exemplary DARIC Binding and Signaling Components

| SEQ ID NO. | Construct | Sequence |
|---|---|---|
| | | AACTACTCAAGAGGAAGATGGCTGTAGCTGCCGATTTCCAGAA<br>GAAGAAGAAGGAGGATGTGAACTGCGGGTGAAGTTCAGCAGA<br>AGCGCCGACGCCCCTGCCTACCAGCAGGGCCAGAATCAGCTGT<br>ACAACGAGCTGAACCTGGGCAGAAGGGAAGAGTACGACGTCC<br>TGGATAAGCGGAGAGGCCGGGACCCTGAGATGGGCGGCAAGC<br>CTCGGCGGAAGAACCCCCAGGAAGGCCTGTATAACGAACTGC<br>AGAAAGACAAGATGGCCGAGGCCTACAGCGAGATCGGCATGA<br>AGGGCGAGCGGAGGCGGGGCAAGGGCCACGACGGCCTGTATC<br>AGGGCCTGTCCACCGCCACCAAGGATACCTACGACGCCCTGCA<br>CATGCAGGCCCTGCCCCCAAGGGGC |
| 23 | FKBP-TM-41BB-CD3z protein | MGSGVQVETISPGDGRTFPKRGQTCVVHYTGMLEDGKKFDSSRD<br>RNKPFKFMLGKQEVIRGWEEGVAQMSVGQRAKLTISPDYAYGA<br>TGHPGIIPPHATLVFDVELLKLEASAKPTTTPAPRPPTPAPTIASQPL<br>SLRPEACRPAAGGAVHTRGLDFACDIYIWAPLAGTCGVLLLSLVI<br>TMHKRGRKKLLYIFKQPFMRPVQTTQEEDGCSCRFPEEEEGGCEL<br>RVKFSRSADAPAYQQGQNQLYNELNLGRREEYDVLDKRRGRDP<br>EMGGKPRRKNPQEGLYNELQKDKMAEAYSEIGMKGERRRGKGH<br>DGLYQGLSTATKDTYDALHMQALPPRG |
| 24 | FKBP-TM-41BB-CD3z mRNA | AUGGCUCUGCCUGUGACAGCUCUGCUGCUGCCUCUGGCCCUG<br>CUGCUCCAUGCCGCCAGACCCGGAUCCGGAGUGCAGGUGGAA<br>ACCAUCUCCCCAGGAGACGGGCGCACCUUCCCCAAGCGCGGC<br>CAGACCUGCGUGGUGCACUACACCGGGAUGCUUGAAGAUGG<br>AAAGAAAUUUGAUUCCUCCCGGGACAGAAACAAGCCCUUUA<br>AGUUUAUGCUAGGCAAGCAGGAGGUGAUCCGAGGCUGGGAA<br>GAAGGGGUUGCCCAGAUGAGUGUGGGUCAGAGAGCCAAACU<br>GACUAUAUCUCCAGAUUAUGCCUAUGGUGCCACUGGGCACC<br>CAGGCAUCAUCCCACCACAUGCCACUCUCGUCUUCGAUGUGG<br>AGCUUCUAAAACUGGAAGCUAGCGCCAAGCCUACCACCACCC<br>CUGCCCCUAGACCUCCAACACCCGCCCCAACAAUCGCCAGCC<br>AGCCUCUGUCUCUGAGGCCCGAGGCUUGUAGACCAGCUGCU<br>GGCGGAGCCGUGCACACCAGAGGACUGGAUUUCGCCUGCGA<br>CAUCUACAUCUGGGCCCCUCUGGCCGGCACAUGUGGCGUGCU<br>GCUGCUGAGCCUCGUGAUCACCAUGCAUAAACGGGGCAGAA<br>AGAAACUCCUGUAUAUAUUCAAACAACCAUUUAUGAGACCA<br>GUACAAACUACUCAAGAGGAAGAUGGCUGUAGCUGCCGAUU<br>UCCAGAAGAAGAAGAAGGAGGAUGUGAACUGCGGGUGAAGU<br>UCAGCAGAAGCGCCGACGCCCCUGCCUACCAGCAGGGCCAGA<br>AUCAGCUGUACAACGAGCUGAACCUGGGCAGAAGGGAAGAG<br>UACGACGUCCUGGAUAAGCGGAGAGGCCGGGACCCUGAGAU<br>GGGCGGCAAGCCUCGGCGGAAGAACCCCCAGGAAGGCCUGU<br>AUAACGAACUGCAGAAAGACAAGAUGGCCGAGGCCUACAGC<br>GAGAUCGGCAUGAAGGGCGAGCGGAGGCGGGGCAAGGGCCA<br>CGACGGCCUGUAUCAGGGCCUGUCCACCGCCACCAAGGAUAC<br>CUACGACGCCCUGCACAUGCAGGCCCUGCCCCCAAGGGGC |
| 25 | FKBP-TM-41BB-CD3z DNA | ATGGCTCTGCCTGTGACAGCTCTGCTGCTGCCTCTGGCCCTGCT<br>GCTCCATGCCGCCAGACCCGGATCCGGAGTGCAGGTGGAAAC<br>CATCTCCCCAGGAGACGGGCGCACCTTCCCCAAGCGCGGCCAG<br>ACCTGCGTGGTGCACTACACCGGGATGCTTGAAGATGGAAAG<br>AAATTTGATTCCTCCCGGGACAGAAACAAGCCCTTTAAGTTTA<br>TGCTAGGCAAGCAGGAGGTGATCCGAGGCTGGGAAGAAGGGG<br>TTGCCCAGATGAGTGTGGGTCAGAGAGCCAAACTGACTATATC<br>TCCAGATTATGCCTATGGTGCCACTGGGCACCCAGGCATCATC<br>CCACCACATGCCACTCTCGTCTTCGATGTGGAGCTTCTAAAAC<br>TGGAAGCTAGCGCCAAGCCTACCACCACCCCTGCCCCTAGACC<br>TCCAACACCCGCCCCAACAATCGCCAGCCAGCCTCTGTCTCTG<br>AGGCCCGAGGCTTGTAGACCAGCTGCTGGCGGAGCCGTGCAC<br>ACCAGAGGACTGGATTTCGCCTGCGACATCTACATCTGGGCCC<br>CTCTGGCCGGCACATGTGGCGTGCTGCTGCTGAGCCTCGTGAT<br>CACCATGCATAAACGGGGCAGAAAGAAACTCCTGTATATATTC<br>AAACAACCATTTATGAGACCAGTACAAACTACTCAAGAGGAA<br>GATGGCTGTAGCTGCCGATTTCCAGAAGAAGAAGAAGGAGGA<br>TGTGAACTGCGGGTGAAGTTCAGCAGAAGCGCCGACGCCCCT<br>GCCTACCAGCAGGGCCAGAATCAGCTGTACAACGAGCTGAAC<br>CTGGGCAGAAGGGAAGAGTACGACGTCCTGGATAAGCGGAGA<br>GGCCGGGACCCTGAGATGGGCGGCAAGCCTCGGCGGAAGAAC<br>CCCCAGGAAGGCCTGTATAACGAACTGCAGAAAGACAAGATG<br>GCCGAGGCCTACAGCGAGATCGGCATGAAGGGCGAGCGGAGG<br>CGGGGCAAGGGCCACGACGGCCTGTATCAGGGCCTGTCCACC<br>GCCACCAAGGATACCTACGACGCCCTGCACATGCAGGCCCTGC<br>CCCCAAGGGGC |

TABLE 1-continued

Exemplary DARIC Binding and Signaling Components

| SEQ ID NO. | Construct | Sequence |
|---|---|---|
| 26 | FKBP-spacer-TM-41BB-CD3z DNA | ATGGCTCTGCCTGTGACAGCTCTGCTGCTGCCTCTGGCCCTGCT<br>GCTCCATGCCGCCAGACCCGGATCCGGAGTGCAGGTGGAAAC<br>CATCTCCCCAGGAGACGGGCGCACCTTCCCCAAGCGCGGCCAG<br>ACCTGCGTGGTGCACTACACCGGGATGCTTGAAGATGGAAAG<br>AAATTTGATTCCTCCCGGGACAGAAACAAGCCCTTTAAGTTTA<br>TGCTAGGCAAGCAGGAGGTGATCCGAGGCTGGGAAGAAGGGG<br>TTGCCCAGATGAGTGTGGGTCAGAGAGCCAAACTGACTATATC<br>TCCAGATTATGCCTATGGTGCCACTGGGCACCCAGGCATCATC<br>CCACCACATGCCACTCTCGTCTTCGATGTGGAGCTTCTAAAAC<br>TGGAAGCTAGCGAGAGCAAGTACGGACCGCCTGCCCACCTT<br>GCCCTGCCCCGAGTTCCTGGGCGGACCCAGCGTGTTCCTGTT<br>CCCACCCAAGCCCAAGGACACCCTGATGATCAGCCGGACCCCC<br>GAGGTGACCTGCGTGGTGGTGGACGTGAGCCAGGAAGATCCC<br>GAGGTCCAGTTCAATTGGTACGTGGACGGCGTGGAAGTGCAC<br>AACGCCAAGACCAAGCCCAGAGAGGAACAGTTCAACAGCACC<br>TACCGGGTGGTGTCTGTGCTGACCGTGCTGCACCAGGACTGGC<br>TGAACGGCAAAGAATACAAGTGCAAGGTGTCCAACAAGGGCC<br>TGCCCAGCAGCATCGAAAAGACCATCAGCAAGGCCAAGGGCC<br>AGCCTCGCGAGCCCCAGGTGTACACCCTGCCTCCCTCCCAGGA<br>AGAGATGACCAAGAACCAGGTGTCCCTGACCTGCCTGGTGAA<br>GGGCTTCTACCCCAGCGACATCGCCGTGGAGTGGGAGAGCAA<br>CGGCCAGCCTGAGAACAACTACAAGACCACCCCTCCCGTGCTG<br>GACAGCGACGGCAGCTTCTTCCTGTACAGCCGGCTGACCGTGG<br>ACAAGAGCCGGTGGCAGGAAGGCAACGTCTTTAGCTGCAGCG<br>TGATGCACGAGGCCCTGCACAACCACTACACCCAGAAGAGCC<br>TGAGCCTGTCCCTGGGCAAGATGCATAAACGGGGCAGAAAGA<br>AACTCCTGTATATATTCAAACAACCATTTATGAGACCAGTACA<br>AACTACTCAAGAGGAAGATGGCTGTAGCTGCCGATTTCCAGAA<br>GAAGAAGAAGGAGGATGTGAACTGCGGGTGAAGTTCAGCAGA<br>AGCGCCGACGCCCCTGCCTACCAGCAGGGCCAGAATCAGCTGT<br>ACAACGAGCTGAACCTGGGCAGAAGGGAAGAGTACGACGTCC<br>TGGATAAGCGGAGAGGCCGGGACCCTGAGATGGGCGGCAAGC<br>CTCGGCGGAAGAACCCCCAGGAAGGCCTGTATAACGAACTGC<br>AGAAAGACAAGATGGCCGAGGCCTACAGCGAGATCGGCATGA<br>AGGGCGAGCGAGGCGGGCAAGGGCCACGACGGCCTGTATC<br>AGGGCCTGTCCACCGCCACCAAGGATACCTACGACGCCCTGCA<br>CATGCAGGCCCTGCCCCCAAGGGGC |
| 37 | SS-2xDmrB-DmrC-TM-41BB-CD3z protein | MALPVTALLLPLALLLHAARPGSGGVQVETISPGDGRTFPKRGQT<br>CVVHYTGMLEDGKKVDSSRDRNKPFKFMLGKQEVIRGWEEGVA<br>QMSVGQRAKLTISPDYAYGATGHPGIIPPHATLVFDVEFLKLESGT<br>SGTSGVQVETISPGDGRTFPKRGQTCVVHYTGMLEDGKKVDSSR<br>DRNKPFKFMLGKQEVIRGWEEGV |
| 38 | SS-2xDmrB-DmrC-TM-41BB-CD3z mRNA | AUGGCUCUGCCUGUGACAGCUCUGCUGCUGCCUCUGGCCCUG<br>CUGCUCCAUGCCGCCAGACCCGGAUCCGGCGGUGUCCAAGUC<br>GAAACUAUAUCGCCUGGCGAUGGCAGAACGUUUCCCAAACG<br>UGGCCAGACCUGUGUCGUACACUAUACCGGCAUGCUAGAGG<br>AUGGGAAAAGGUUGAUUCCAGUCGCGAUCGGAACAAACCG<br>UUUAAAUUCAUGUUGGGGAAGCAAGAGGUUAUCAGGGGAUG<br>GGAAGAGGGUGUCGCGCAAAUGUCGGUUGGGCAACGUGCGA<br>AACUCACAAUUUCCCCGGAUUACGCAUACGGAGCUACCGGAC<br>ACCCUGGGAUUAUCCACCGCAUGCGACGCUAGUGUUUGAC<br>GUAGAGUUCUUGAAGCUCGAAUCAGGUACAAGCGGCACUUC<br>UGGCGUACAGGUUGAGACAAUUAGUCCCGGAGACGGACGUA<br>CAUUCCCAAAGAGAGGGCAAACUUGCGUAGUCCAUUACACU<br>GGAAUGUUGGAAGACGGCAAGAAAGUGGACAGUUCAAGAGA<br>CCGCAAUAAGCCUUUCAAGUUUAUGCUCGGAAAACAGGAAG<br>UCAUACGCGGUUGGGAGGAAGGCGUGGCUCAGAUGAGCGUC<br>GGACAGAGGGCAAAGUUGACCAUCAGUCCCGACUAUGCGUA<br>UGGCGCGACAGGCCAUCCCGGAAUCAUACCUCCCCACGCAAC<br>CUUGGUAUUCGAUGUCGAACUGCUCAAAUUAGAGGGUAGUA<br>GAUCCAUCCUCUGGCAUGAGAUGUGGCAUGAAGGCCUGGAA<br>GAGGCAUCUCGUUUGUACUUUGGGGAAAGGAACGUGAAAGG<br>CAUGUUUGAGGUGCUGGAGCCCUUGCAUGCUAUGAUGGAAC<br>GGGGCCCCCAGACUCUGAAGGAAACAUCCUUUAAUCAGGCU<br>UAUGGUCGAGAUUUAAUGGAGGCCCAAGAGUGGUGCAGGAA<br>GUACAUGAAAUCAGGGAAUGUCAAGGACCUCCUCCAAGCCU<br>GGGACCUCUAUUAUCAUGUGUUCCGACGAAUCUCAAAGGCU<br>AGCGCCAAGCCUACCACCACCCUGCCCCUAGACCUCCAACA<br>CCCGCCCCAACAAUCGCCAGCCAGCCUCUGUCUCUGAGGCCC<br>GAGGCUUGUAGACCAGCUGCUGGCGGAGCCGUACACACCAG<br>AGGACUGGAUUUCGCCUGCGACAUCUACAUCUGGGCCCUCU<br>GGCCGGCACAUGUGGCGUCGCUGCUGAGCCUCGUGAUCA<br>CCAUGCAUAAACGGGGCAGAAAGAAACUCCUGUAUAUAUUC TABLE 1-continued Exemplary DARIC Binding and Signaling Components

| SEQ ID NO. | Construct | Sequence |
|---|---|---|
| | | AAACAACCAUUUAUGAGACCAGUACAAACUACUCAAGAGGA AGAUGGCUGUAGCUGCCGAUUUCCAGAAGAAGAAGAAGGAG GAUGUGAACUGCGGGUGAAGUUCAGCAGAAGCGCCGACGC CCUGCCUACCAGCAGGGCCAGAAUCAGCUGUACAACGAGCUG AACCUGGGCAGAAGGGAAGAGUACGACGUCCUGGAUAAGCG GAGAGGCCGGGACCCUGAGAUGGGCGGCAAGCCUCGGCGGA AGAACCCCAGGAAGGCCUGUAUAACGAACUGCAGAAAGAC AAGAUGGCCGAGGCCUACAGCGAGAUCGGCAUGAAGGGCGA GCGGAGGCGGGGCAAGGGCCACGACGGCCUGUAUCAGGGCC UGUCCACCGCCACCAAGGAUACCUACGACGCCCUGCACAUGC AGGCCCUGCCCCAAGGGGC |
| 39 | SS-2xDmrB-DmrC-TM-41BB-CD3z DNA | ATGGCTCTGCCTGTGACAGCTCTGCTGCTGCCTCTGGCCCTGCT GCTCCATGCCGCCAGACCCGGATCCGGCGGTGTCCAAGTCGAA ACTATATCGCCTGGCGATGGCAGAACGTTTCCCAAACGTGGCC AGACCTGTCGTACACTATACCGGCATGCTAGAGGATGGGAA AAAGGTTGATTCCAGTCGCGATCGGAACAAACCGTTTAAATTC ATGTTGGGGAAGCAAGAGGTTATCAGGGGATGGGAAGAGGGT GTCGCGCAAATGTCGGTTGGGCAACGTGCGAAACTCACAATTT CCCCGGATTACGCATACGGAGCTACCGGACACCCTGGGATTAT CCCACCGCATGCGACGCTAGTGTTTGACGTAGAGTTCTTGAAG CTCGAATCAGGTACAAGCGGCACTTCTGGCGTACAGGTTGAGA CAATTAGTCCCGGAGACGGACGTACATTCCCAAAGAGAGGGC AAACTTGCGTAGTCCATTACACTGGAATGTTGGAAGACGGCAA GAAAGTGGACAGTTCAAGAGACCGCAATAAGCCTTTCAAGTTT ATGCTCGGAAAACAGGAAGTCATACGCGGTTGGGAGGAAGGC GTGGCTCAGATGAGCGTCGGACAGAGGGCAAAGTTGACCATC AGTCCCGACTATGCGTATGGCGCGACAGGCCATCCCGGAATCA TACCTCCCCACGCAACCTTGGTATTCGATGTCGAACTGCTCAA ATTAGAGGGTAGTAGATCCATCCTCTGGCATGAGATGTGGCAT GAAGGCCTGGAAGAGGCATCTCGTTTGTACTTTGGGGAAAGG AACGTGAAAGGCATGTTTGAGGTGCTGGAGCCCTTGCATGCTA TGATGGAACGGGGCCCCCAGACTCTGAAGGAAACATCCTTTAA TCAGGCCTATGGTCGAGATTTAATGGAGGCCCAAGAGTGGTGC AGGAAGTACATGAAATCAGGGAATGTCAAGGACCTCCTCCAA GCCTGGGACCTCTATTATCATGTGTTCCGACGAATCTCAAAGG CTAGCGCCAAGCCTACCACCACCCCTGCCCCTAGACCTCCAAC ACCCGCCCCAACAATCGCCAGCCAGCCTCTGTCTCTGAGGCCC GAGGCTTGTAGACCAGCTGCTGGCGGAGCCGTACACACCAGA GGACTGGATTTCGCCTGCGACATCTACATCTGGGCCCCTCTGG CCGGCACATGTGGCGTGCTGCTGCTGAGCCTCGTGATCACCAT GCATAAACGGGGCAGAAAGAAACTCCTGTATATATTCAAACA ACCATTTATGAGACCAGTACAAACTACTCAAGAGGAAGATGG CTGTAGCTGCCGATTTCCAGAAGAAGAAGAAGGAGGATGTGA ACTGCGGGTGAAGTTCAGCAGAAGCGCCGACGCCCCTGCCTAC CAGCAGGGCCAGAATCAGCTGTACAACGAGCTGAACCTGGGC AGAAGGGAAGAGTACGACGTCCTGGATAAGCGGAGAGGCCGG GACCCTGAGATGGGCGGCAAGCCTCGGCGGAAGAACCCCCAG GAAGGCCTGTATAACGAACTGCAGAAAGACAAGATGGCCGAG GCCTACAGCGAGATCGGCATGAAGGGCGAGCGGAGGCGGGGC AAGGGCCACGACGGCCTGTATCAGGGCCTGTCCACCGCCACCA AGGATACCTACGACGCCCTGCACATGCAGGCCCTGCCCCCAAG GGGC |
| 41 | SS-scFvCD19-DmrA-fuP2A-DmrC-TM-41BB-CD3z protein | METDTLLLWVLLLWVPGSTGDYKDEGSDIQMTQTTSSLSASLGD RVTISCRASQDISKYLNWYQQKPDGTVKLLIYHTSRLHSGVPSRFS GSGSGTDYSLTISNLEQEDIATYFCQQGNTLPYTFGGGTKLEITGS TSGSGKPGSGEGSTKGEVKLQESGPGLVAPSQSLSVTCTVSGVSL PDYGVSWIRQPPRKGLEWLGVIWGSE |
| 42 | SS-scFvCD19-DmrA-fuP2A-DmrC-TM-41BB-CD3z DNA | ATGGAGACAGACACACTCCTGCTATGGGTACTGCTGCTCTGGG TTCCAGGTTCCACTGGTGACTACAAGGACGAGGGATCCGATAT CCAGATGACCCAGACCACCAGCAGCCTGAGCGCCAGCCTGGG CGATAGAGTGACCATCAGCTGCAGAGCCAGCCAGGACATCAG CAAGTACCTGAACTGGTATCAGCAGAAACCCGACGGCACCGT GAAGCTGCTGATCTACCACACCAGCAGACTGCACAGCGGCGT GCCCAGCAGATTTTCTGGCAGCGGCTCCGGCACCGACTACAGC CTGACCATCTCCAACCTGGAACAGGAAGATATCGCTACCTACT TCTGTCAGCAAGGCAACACCCTGCCCTACACCTTCGGCGGAGG CACCAAGCTGGAAATCACCGGCAGCACAAGCGGCAGCGGCAA GCCTGGATCTGGCGAGGGAAGCACCAAGGGCGAAGTGAAACT GCAGGAAAGCGGCCCTGGACTGGTGGCCCCAAGCCAGTCTCT GAGCGTGACCTGTACCGTGTCCGGCGTGTCCCTGCCTGACTAT GGCGTGTCCTGGATCAGACAGCCACCCAGAAAGGGCCTGGAA TGGCTGGGAGTGATCTGGGGCAGCGAGACAACCTACTACAAC |

TABLE 1-continued

Exemplary DARIC Binding and Signaling Components

| SEQ ID NO. | Construct | Sequence |
|---|---|---|
| | | AGCGCCCTGAAGTCCCGGCTGACCATCATCAAGGACAACTCCA<br>AGAGCCAGGTGTTCCTGAAGATGAACAGCCTGCAGACCGACG<br>ACACCGCCATCTACTACTGCGCCAAGCACTACTACTACGGCGG<br>CAGCTACGCCATGGACTACTGGGGCCAGGGCACAAGCGTGAC<br>CGTGTCCAGCGCTAGCGGCTCAGGAGGAGTGCAGGTTGAAAC<br>CATCTCCCCAGGAGACGGGCGCACCTTCCCGAAGCGCGGACA<br>GACATGCGTGGTGCACTACACCGGGATGCTTGAAGATGGAAA<br>GAAATTCGATTCATCGCGGGACAGAAACAAGCCCTTTAAGTTT<br>ATGCTGGGCAAGCAGGAGGTCATCCGAGGCTGGGAAGAAGGG<br>GTTGCCCAGATGAGTGTCGGCCAGAGAGCCAAACTGACTATAT<br>CACCTGACTACGCCTATGGGGCCACTGGGCACCCTGGCATAAT<br>TCCGCCACACGCCACTCTCGTCTTCGATGTGGAGCTTCTAAAA<br>CTGGAAGGCGGCCGCGCTCGTTACAAGCGAAGTGTCTCAGGAT<br>CTGGCGCCACGAACTTCTCTCTGTTAAAGCAAGCAGGAGATGT<br>TGAAGAAAACCCCGGGCCTTCAAGATCCATCCTCTGGCATGAG<br>ATGTGGCATGAAGGCCTGGAAGAGGCATCTCGTTTGTACTTTG<br>GGGGAAAGGAACGTGAAAGGCATGTTTGAGGTGCTGGAGCCCT<br>TGCATGCTATGATGGAACGGGGCCCCCAGACTCTGAAGGAAA<br>CATCCTTTAATCAGGCCTATGGTCGAGATTTAATGGAGGCCCA<br>AGAGTGGTGCAGGAAGTACATGAAATCAGGGAATGTCAAGGA<br>CCTCCTCCAAGCCTGGGACCTCTATTATCATGTGTTCCGACGA<br>ATCTCAAAGGCTAGCGCCAAGCCTACCACCACCCCTGCCCCTA<br>GACCTCCAACACCCGCCCCAACAATCGCCAGCCAGCCTCTGTC<br>TCTGAGGCCCGAGGCTTGTAGACCAGCTGCTGGCGGAGCCGTA<br>CACACCAGAGGACTGGATTTCGCCTGCGACATCTACATCTGGG<br>CCCCTCTGGCCGGCACATGTGGCGTGCTGCTGCTGAGCCTCGT<br>GATCACCATGCATAAACGGGGCAGAAAGAAACTCCTGTATAT<br>ATTCAAACAACCATTTATGAGACCAGTACAAACTACTCAAGAG<br>GAAGATGGCTGTAGCTGCCGATTTCCAGAAGAAGAAGAAGGA<br>GGATGTGAACTGCGGGTGAAGTTCAGCAGAAGCGCCGACGCC<br>CCTGCCTACCAGCAGGGCCAGAATCAGCTGTACAACGAGCTG<br>AACCTGGGCAGAAGGGAAGAGTACGACGTCCTGGATAAGCGG<br>AGAGGCCGGGACCCTGAGATGGGCGGCAAGCCTCGGCGGAAG<br>AACCCCCAGGAAGGCCTGTATAACGAACTGCAGAAAGACAAG<br>ATGGCCGAGGCCTACAGCGAGATCGGCATGAAGGGCGAGCGG<br>AGGCGGGGCAAGGGCCACGACGGCCTGTATCAGGGCCTGTCC<br>ACCGCTACCAAGGATACCTACGACGCCCTGCACATGCAGGCCC<br>TGCCCCCAAGGGGC |
| 44 | SS-scFvCD19-DmrA-<br>fuP2A-FRB-TM-41BB-<br>CD3z protein | METDTLLLWVLLLWVPGSTGDYKDEGSDIQMTQTTSSLSASLGD<br>RVTISCRASQDISKYLNWYQQKPDGTVKLLIYHTSRLHSGVPSRFS<br>GSGSGTDYSLTISNLEQEDIATYFCQQGNTLPYTFGGGTKLEITGS<br>TSGSGKPGSGEGSTKGEVKLQESGPGLVAPSQSLSVTCTVSGVSL<br>PDYGVSWIRQPPRKGLEWLGVIWGSE |
| 45 | SS-scFvCD19-DmrA-<br>fuP2A-FRB-TM-41BB-<br>CD3z DNA | ATGGAGACAGACACACTCCTGCTATGGGTACTGCTGCTCTGGG<br>TTCCAGGTTCCACTGGTGACTACAAGGACGAGGGATCCGATAT<br>CCAGATGACCCAGACCACCAGCAGCCTGAGCGCCAGCCTGGG<br>CGATAGAGTGACCATCAGCTGCAGAGCCAGCCAGGACATCAG<br>CAAGTACCTGAACTGGTATCAGCAGAAACCCGACGGCACCGT<br>GAAGCTGCTGATCTACCACACCAGCAGACTGCACAGCGGCGT<br>GCCCAGCAGATTTTCTGGCAGCGGCTCCGGCACCGACTACAGC<br>CTGACCATCTCCAACCTGGAACAGGAAGATATCGCTACCTACT<br>TCTGTCAGCAAGGCAACACCCTGCCCTACACCTTCGGCGGAGG<br>CACCAAGCTGGAAATCACCGGCAGCACAAGCGGCAGCGGCAA<br>GCCTGGATCTGGCGAGGGAAGCACCAAGGGCGAAGTGAAACT<br>GCAGGAAAGCGGCCCTGGACTGGTGGCCCCAAGCCAGTCTCT<br>GAGCGTGACCTGTACCGTGTCCGGCGTGTCCCTGCCTGACTAT<br>GGCGTGTCCTGGATCAGACAGCCACCCAGAAAGGGCCTGGAA<br>TGGCTGGGAGTGATCTGGGGCAGCGAGACAACCTACTACAAC<br>AGCGCCCTGAAGTCCCGGCTGACCATCATCAAGGACAACTCCA<br>AGAGCCAGGTGTTCCTGAAGATGAACAGCCTGCAGACCGACG<br>ACACCGCCATCTACTACTGCGCCAAGCACTACTACTACGGCGG<br>CAGCTACGCCATGGACTACTGGGGCCAGGGCACAAGCGTGAC<br>CGTGTCCAGCGCTAGCGGCTCAGGAGGAGTGCAGGTTGAAAC<br>CATCTCCCCAGGAGACGGGCGCACCTTCCCGAAGCGCGGACA<br>GACATGCGTGGTGCACTACACCGGGATGCTTGAAGATGGAAA<br>GAAATTCGATTCATCGCGGGACAGAAACAAGCCCTTTAAGTTT<br>ATGCTGGGCAAGCAGGAGGTCATCCGAGGCTGGGAAGAAGGG<br>GTTGCCCAGATGAGTGTCGGCCAGAGAGCCAAACTGACTATAT<br>CACCTGACTACGCCTATGGGGCCACTGGGCACCCTGGCATAAT<br>TCCGCCACACGCCACTCTCGTCTTCGATGTGGAGCTTCTAAAA<br>CTGGAAGGCGGCCGCGCTCGTTACAAGCGAAGTGTCTCAGGAT<br>CTGGCGCCACGAACTTCTCTCTGTTAAAGCAAGCAGGAGATGT<br>TGAAGAAAACCCCGGGCCTTCAAGATCCATCCTCTGGCATGAG |

TABLE 1-continued

Exemplary DARIC Binding and Signaling Components

| SEQ ID NO. | Construct | Sequence |
|---|---|---|
|  |  | ATGTGGCATGAAGGCCTGGAAGAGGCATCTCGTTTGTACTTTG<br>GGGAAAGGAACGTGAAAGGCATGTTTGAGGTGCTGGAGCCCT<br>TGCATGCTATGATGGAACGGGGCCCCCAGACTCTGAAGGAAA<br>CATCCTTTAATCAGGCCTATGGTCGAGATTTAATGGAGGCCCA<br>AGAGTGGTGCAGGAAGTACATGAAATCAGGGAATGTCAAGGA<br>CCTCACCCAAGCCTGGGACCTCTATTATCATGTGTTCCGACGA<br>ATCTCAAAGGCTAGCGCCAAGCCTACCACCACCCCTGCCCCTA<br>GACCTCCAACACCCGCCCCAACAATCGCCAGCCAGCCTCTGTC<br>TCTGAGGCCCGAGGCTTGTAGACCAGCTGCTGGCGGAGCCGTA<br>CACACCAGAGGACTGGATTTCGCCTGCGACATCTACATCTGGG<br>CCCCTCTGGCCGGCACATGTGGCGTGCTGCTGCTGAGCCTCGT<br>GATCACCATGCATAAACGGGGCAGAAAGAAACTCCTGTATAT<br>ATTCAAACAACCATTTATGAGACCAGTACAAACTACTCAAGAG<br>GAAGATGGCTGTAGCTGCCGATTTCCAGAAGAAGAAGAAGGA<br>GGATGTGAACTGCGGGTGAAGTTCAGCAGAAGCGCCGACGCC<br>CCTGCCTACCAGCAGGGCCAGAATCAGCTGTACAACGAGCTG<br>AACCTGGGCAGAAGGGAAGAGTACGACGTCCTGGATAAGCGG<br>AGAGGCCGGGACCCTGAGATGGGCGGCAAGCCTCGGCGGAAG<br>AACCCCCAGGAAGGCCTGTATAACGAACTGCAGAAAGACAAG<br>ATGGCCGAGGCCTACAGCGAGATCGGCATGAAGGGCGAGCGG<br>AGGCGGGGCAAGGGCCACGACGGCCTGTATCAGGGCCTGTCC<br>ACCGCCACCAAGGATACCTACGACGCCCTGCACATGCAGGCCC<br>TGCCCCCAAGGGGC |
| 47 | SS-scFvCD19-DmrA-fuP2A-2xDmrB-DmrC-TM-41BB-CD3z protein | METDTLLLWVLLLWVPGSTGDYKDEGSDIQMTQTTSSLSASLGD<br>RVTISCRASQDISKYLNWYQQKPDGTVKLLIYHTSRLHSGVPSRFS<br>GSGSGTDYSLTISNLEQEDIATYFCQQGNTLPYTFGGGTKLEITGS<br>TSGSGKPGSGEGSTKGEVKLQESGPGLVAPSQSLSVTCTVSGVSL<br>PDYGVSWIRQPPRKGLEWLGVIWGSE |
| 48 | SS-scFvCD19-DmrA-fuP2A-2xDmrB-DmrC-TM-41BB-CD3z DNA | ATGGAGACAGACACACTCCTGCTATGGGTACTGCTGCTCTGGG<br>TTCCAGGTTCCACTGGTGACTACAAGGACGAGGGATCCGATAT<br>CCAGATGACCCAGACCACCAGCCTGAGCGCCAGCCTGGG<br>CGATAGAGTGACCATCAGCTGCAGAGCCAGCCAGGACATCAG<br>CAAGTACCTGAACTGGTATCAGCAGAAACCCGACGGCACCGT<br>GAAGCTGCTGATCTACCACACCAGCAGACTGCACAGCGGCGT<br>GCCCAGCAGATTTTCTGGCAGCGGCTCCGGCACCGACTACAGC<br>CTGACCATCTCCAACCTGGAACAGGAAGATATCGCTACCTACT<br>TCTGTCAGCAAGGCAACACCCTGCCCTACACCTTCGGCGGAGG<br>CACCAAGCTGGAAATCACCGGCAGCACAAGCGGCAGCGGCAA<br>GCCTGGATCTGGCGAGGGAAGCACCAAGGGCGAAGTGAAACT<br>GCAGGAAAGCGGCCCTGGACTGGTGGCCCCAAGCCAGTCTCT<br>GAGCGTGACCTGTACCGTGTCCGGCGTGTCCCTGCCTGACTAT<br>GGCGTGTCCTGGATCAGACAGCCACCCAGAAAGGGCCTGGAA<br>TGGCTGGGAGTGATCTGGGGCAGCGAGACAACCTACTACAAC<br>AGCGCCCTGAAGTCCCGGCTGACCATCATCAAGGACAACTCCA<br>AGAGCCAGGTGTTCCTGAAGATGAACAGCCTGCAGACCGACG<br>ACACCGCCATCTACTACTGCGCCAAGCACTACTACTACGGCGG<br>CAGCTACGCCATGGACTACTGGGGCCAGGGCACAAGCGTGAC<br>CGTGTCCAGCGCTAGCGGCTCAGGAGGAGTGCAGGTTGAAAC<br>CATCTCCCCAGGAGACGGGCGCACCTTCCCGAAGCGCGGACA<br>GACATGCGTGGTGCACTACACCGGGATGCTTGAAGATGGAAA<br>GAAATTCGATTCATCGCGGGACAGAAACAAGCCCTTTAAGTTT<br>ATGCTGGGCAAGCAGGAGGTCATCCGAGGCTGGGAAGAAGGG<br>GTTGCCCAGATGAGTGTCGGCCAGAGAGCCAAACTGACTATAT<br>CACCTGACTACGCCTATGGGGCCACTGGGCACCCTGGCATAAT<br>TCCGCCACACGCCACTCTCGTCTTCGATGTGGAGCTTCTAAAA<br>CTGGAAGGCGGCCGCGCTCGTTACAAGCGAAGTGTCTCAGGAT<br>CTGGCGCCACGAACTTCTCTCTGTTAAAGCAAGCAGGAGATGT<br>TGAAGAAAACCCCGGGCCTTCAAGATCCGGCGTGTCCAAGTC<br>GAAACTATATCGCCTGGCGATGGCAGAACGTTTCCCAAACGTG<br>GCCAGACCTGTGTCGTACACTATACCGGCATGCTAGAGGATGG<br>GAAAAAGGTTGATTCCAGTCGCGATCGGAACAAACCGTTTAA<br>ATTCATGTTGGGGAAGCAAGAGGTTATCAGGGGATGGGAAGA<br>GGGTGTCGCGCAAATGTCGGTTGGGCAACGTGCGAAACTCAC<br>AATTTCCCCGGATTACGCATACGGAGCTACCGGACACCCTGGG<br>ATTATCCCACCGCATGCGACGCTAGTGTTTGACGTAGAGTTCT<br>TGAAGCTCGAATCAGGTACAAGCGGCACTTCTGGCGTACAGGT<br>TGAGACAATTAGTCCCGGAGACGGACGTACATTCCCAAAGAG<br>AGGGCAAACTTGCGTAGTCCATTACACTGGAATGTTGGAAGAC<br>GGCAAGAAAGTGGACAGTTCAAGAGACCGCAATAAGCCTTTC<br>AAGTTTATGCTCGGAAAACAGGAAGTCATACGCGGTTGGGAG<br>GAAGGCGTGGCTCAGATGAGCGTCGGACAGAGGGCAAAGTTG<br>ACCATCAGTCCCGACTATGCGTATGGCGCGACAGGCCATCCCG<br>GAATCATACCTCCCCACGCAACCTTGGTATTCGATGTCGAACT |

TABLE 1-continued

Exemplary DARIC Binding and Signaling Components

| SEQ ID NO. | Construct | Sequence |
|---|---|---|
| | | GCTCAAATTAGAGGGTAGTAGATCCATCCTCTGGCATGAGATG<br>TGGCATGAAGGCCTGGAAGAGGCATCTCGTTTGTACTTTGGGG<br>AAAGGAACGTGAAAGGCATGTTTGAGGTGCTGGAGCCCTTGC<br>ATGCTATGATGGAACGGGGCCCCCAGACTCTGAAGGAAACAT<br>CCTTTAATCAGGCCTATGGTCGAGATTTAATGGAGGCCCAAGA<br>GTGGTGCAGGAAGTACATGAAATCAGGGAATGTCAAGGACCT<br>CCTCCAAGCCTGGGACCTCTATTATCATGTGTTCCGACGAATCT<br>CAAAGGCTAGCGCCAAGCCTACCACCACCCCTGCCCCTAGACC<br>TCCAACACCCGCCCCAACAATCGCCAGCCAGCCTCTGTCTCTG<br>AGGCCCGAGGCTTGTAGACCAGCTGCTGGCGGAGCCGTACAC<br>ACCAGAGGACTGGATTTCGCCTGCGACATCTACATCTGGGCCC<br>CTCTGGCCGGCACATGTGGCGTGCTGCTGCTGAGCCTCGTGAT<br>CACCATGCATAAACGGGGCAGAAAGAAACTCCTGTATATATTC<br>AAACAACCATTTATGAGACCAGTACAAACTACTCAAGAGGAA<br>GATGGCTGTAGCTGCCGATTTCCAGAAGAAGAAGAAGGAGGA<br>TGTGAACTGCGGGTGAAGTTCAGCAGAAGCGCCGACGCCCCT<br>GCCTACCAGCAGGGCCAGAATCAGCTGTACAACGAGCTGAAC<br>CTGGGCAGAAGGGAAGAGTACGACGTCCTGGATAAGCGGAGA<br>GGCCGGGACCCTGAGATGGGCGGCAAGCCTCGGCGGAAGAAC<br>CCCCAGGAAGGCCTGTATAACGAACTGCAGAAAGACAAGATG<br>GCCGAGGCCTACAGCGAGATCGGCATGAAGGGCGAGCGGAGG<br>CGGGGCAAGGGCCACGACGGCCTGTATCAGGGCCTGTCCACC<br>GCCACCAAGGATACCTACGACGCCCTGCACATGCAGGCCCTGC<br>CCCCAAGGGGC |
| 50 | SS-CD19scFv-DmrA-CD4TM protein | MPLGLLWLGLALLGALHAQAGSDIQMTQTTSSLSASLGDRVTISC<br>RASQDISKYLNWYQQKPDGTVKLLIYHTSRLHSGVPSRFSGSGSG<br>TDYSLTISNLEQEDIATYFCQQGNTLPYTFGGGTKLEITGSTSGSG<br>KPGSGEGSTKGEVKLQESGPGLVAPSQSLSVTCTVSGVSLPDYGV<br>SWIRQPPRKGLEWLGVIWGSETTYYN |
| 51 | SS-CD19scFv-DmrA-CD4TM DNA | ATGCCCCTGGGCCTGCTGTGGCTGGGCCTGGCCCTGCTGGGCG<br>CCCTGCACGCCCAGGCCGGATCCGATATCCAGATGACCCAGAC<br>CACCAGCAGCCTGAGCGCCAGCCTGGGCGATAGAGTGACCAT<br>CAGCTGCAGAGCCAGCCAGGACATCAGCAAGTACCTGAACTG<br>GTATCAGCAGAAACCCGACGGCACCGTGAAGCTGCTGATCTAC<br>CACACCAGCAGACTGCACAGCGGCGTGCCCAGCAGATTTTCTG<br>GCAGCGGCTCCGGCACCGACTACAGCCTGACCATCTCCAACCT<br>GGAACAGGAAGATATCGCTACCTACTTCTGTCAGCAAGGCAAC<br>ACCCTGCCCTACACCTTCGGCGGAGGCACCAAGCTGGAAATCA<br>CCGGCAGCACAAGCGGCAGCGGCAAGCCTGGATCTGGCGAGG<br>GAAGCACCAAGGGCGAAGTGAAACTGCAGGAAAGCGGCCCTG<br>GACTGGTGGCCCCAAGCCAGTCTCTGAGCGTGACCTGTACCGT<br>GTCCGGCGTGTCCCTGCCTGACTATGGCGTGTCCTGGATCAGA<br>CAGCCACCCAGAAAGGGCCTGGAATGGCTGGGAGTGATCTGG<br>GGCAGCGAGACAACCTACTACAACAGCGCCCTGAAGTCCCGG<br>CTGACCATCATCAAGGACAACTCCAAGAGCCAGGTGTTCCTGA<br>AGATGAACAGCCTGCAGACCGACGACACCGCCATCTACTACTG<br>CGCCAAGCACTACTACTACGGCGGCAGCTACGCCATGGACTAC<br>TGGGGCCAGGGCACAAGCGTGACCGTGTCCAGCGCTAGCGGC<br>GGAGGTGGGAGCGGAGTGCAGGTGGAAACCATCTCCCCAGGA<br>GACGGGCGCACCTTCCCCAAGCGCGGCCAGACCTGCTGGTGC<br>ACTACACCGGGATGCTTGAAGATGGAAAGAAATTTGATTCCTC<br>CCGGGACAGAAACAAGCCCTTTAAGTTTATGCTAGGCAAGCA<br>GGAGGTGATCCGAGGCTGGGAAGAAGGGGTTGCCCAGATGAG<br>TGTGGGTCAGAGAGCCAAACTGACTATATCTCCAGATTATGCC<br>TATGGTGCCACTGGGCACCCAGGCATCATCCCACCACATGCCA<br>CTCTCGTCTTCGATGTGGAGCTTCTAAAACTGGAAGGCGCCG<br>CATGGCCCTGATTGTGCTGGGGGGCGTCGCCGGCCTCCTGCTT<br>TTCATTGGGCTAGGCATCTTCTTC |
| 53 | SS-CD19scFv-DmrA-CD8hingeTM protein | MPLGLLWLGLALLGALHAQAGSDIQMTQTTSSLSASLGDRVTISC<br>RASQDISKYLNWYQQKPDGTVKLLIYHTSRLHSGVPSRFSGSGSG<br>TDYSLTISNLEQEDIATYFCQQGNTLPYTFGGGTKLEITGSTSGSG<br>KPGSGEGSTKGEVKLQESGPGLVAPSQSLSVTCTVSGVSLPDYGV<br>SWIRQPPRKGLEWLGVIWGSETTYYN |
| 54 | SS-CD19scFv-DmrA-CD8hingeTM DNA | ATGCCCCTGGGCCTGCTGTGGCTGGGCCTGGCCCTGCTGGGCG<br>CCCTGCACGCCCAGGCCGGATCCGATATCCAGATGACCCAGAC<br>CACCAGCAGCCTGAGCGCCAGCCTGGGCGATAGAGTGACCAT<br>CAGCTGCAGAGCCAGCCAGGACATCAGCAAGTACCTGAACTG<br>GTATCAGCAGAAACCCGACGGCACCGTGAAGCTGCTGATCTAC<br>CACACCAGCAGACTGCACAGCGGCGTGCCCAGCAGATTTTCTG<br>GCAGCGGCTCCGGCACCGACTACAGCCTGACCATCTCCAACCT<br>GGAACAGGAAGATATCGCTACCTACTTCTGTCAGCAAGGCAAC |

TABLE 1-continued

Exemplary DARIC Binding and Signaling Components

| SEQ ID NO. | Construct | Sequence |
|---|---|---|
| | | ACCCTGCCCTACACCTTCGGCGGAGGCACCAAGCTGGAAATCA<br>CCGGCAGCACAAGCGGCAGCGGCAAGCCTGGATCTGGCGAGG<br>GAAGCACCAAGGGCGAAGTGAAACTGCAGGAAAGCGGCCCTG<br>GACTGGTGGCCCCAAGCCAGTCTCTGAGCGTGACCTGTACCGT<br>GTCCGGCGTGTCCCTGCCTGACTATGGCGTGTCCTGGATCAGA<br>CAGCCACCCAGAAAGGGCCTGGAATGGCTGGGAGTGATCTGG<br>GGCAGCGAGACAACCTACTACAACAGCGCCCTGAAGTCCCGG<br>CTGACCATCATCAAGGACAACTCCAAGAGCCAGGTGTTCCTGA<br>AGATGAACAGCCTGCAGACCGACGACACCGCCATCTACTACTG<br>CGCCAAGCACTACTACTACGGCGGCAGCTACGCCATGGACTAC<br>TGGGGCCAGGGCACAAGCGTGACCGTGTCCAGCGCTAGCGGC<br>GGAGGTGGGAGCGGAGTGCAGGTGGAAACCATCTCCCCAGGA<br>GACGGGCGCACCTTCCCCAAGCGCGGCCAGACCTGCGTGGTGC<br>ACTACACCGGGATGCTTGAAGATGGAAAGAAATTTGATTCCTC<br>CCGGGACAGAAACAAGCCCTTTAAGTTTATGCTAGGCAAGCA<br>GGAGGTGATCCGAGGCTGGGAAGAAGGGGTTGCCCAGATGAG<br>TGTGGGTCAGAGAGCCAAACTGACTATATCTCCAGATTATGCC<br>TATGGTGCCACTGGGCACCCAGGCATCATCCCACCACATGCCA<br>CTCTCGTCTTCGATGTGGAGCTTCTAAAACTGGAAGGCGGCCG<br>CGCCAAGCCTACCACCACCCCTGCCCCTAGACCTCCAACACCC<br>GCCCCAACAATCGCCAGCCAGCCTCTGTCTCTGAGGCCCGAGG<br>CTTGTAGACCAGCTGCTGGCGGAGCCGTGCACACCAGAGGACT<br>GGATTTCGCCTGCGACATCTACATCTGGGCCCCTCTGGCCGGC<br>ACATGTGGCGTGCTGCTGAGCCTCGTGATCACC |
| 56 | SS-CD19scFv-DmrA-Spacer-CD4TM protein | MPLGLLWLGLALLGALHAQAGSDIQMTQTTSSLSASLGDRVTISC<br>RASQDISKYLNWYQQKPDGTVKLLIYHTSRLHSGVPSRFSGSGSG<br>TDYSLTISNLEQEDIATYFCQQGNTLPYTFGGGTKLEITGSTSGSG<br>KPGSGEGSTKGEVKLQESGPGLVAPSQSLSVTCTVSGVSLPDYGV<br>SWIRQPPRKGLEWLGVIWGSETTYYN |
| 57 | SS-CD19scFv-DmrA-Spacer-CD4TM DNA | ATGCCCCTGGGCCTGCTGTGGCTGGGCCTGGCCCTGCTGGGCG<br>CCCTGCACGCCCAGGCCGGATCCGATATCCAGATGACCCAGAC<br>CACCAGCAGCCTGAGCGCCAGCCTGGGCGATAGAGTGACCAT<br>CAGCTGCAGAGCCAGCCAGGACATCAGCAAGTACCTGAACTG<br>GTATCAGCAGAAACCCGACGGCACCGTGAAGCTGCTGATCTAC<br>CACACCAGCAGACTGCACAGCGGCGTGCCCAGCAGATTTTCTG<br>GCAGCGGCTCCGGCACCGACTACAGCCTGACCATCTCCAACCT<br>GGAACAGGAAGATATCGCTACCTACTTCTGTCAGCAAGGCAAC<br>ACCCTGCCCTACACCTTCGGCGGAGGCACCAAGCTGGAAATCA<br>CCGGCAGCACAAGCGGCAGCGGCAAGCCTGGATCTGGCGAGG<br>GAAGCACCAAGGGCGAAGTGAAACTGCAGGAAAGCGGCCCTG<br>GACTGGTGGCCCCAAGCCAGTCTCTGAGCGTGACCTGTACCGT<br>GTCCGGCGTGTCCCTGCCTGACTATGGCGTGTCCTGGATCAGA<br>CAGCCACCCAGAAAGGGCCTGGAATGGCTGGGAGTGATCTGG<br>GGCAGCGAGACAACCTACTACAACAGCGCCCTGAAGTCCCGG<br>CTGACCATCATCAAGGACAACTCCAAGAGCCAGGTGTTCCTGA<br>AGATGAACAGCCTGCAGACCGACGACACCGCCATCTACTACTG<br>CGCCAAGCACTACTACTACGGCGGCAGCTACGCCATGGACTAC<br>TGGGGCCAGGGCACAAGCGTGACCGTGTCCAGCGCTAGCGGC<br>GGAGGTGGGAGCGGAGTGCAGGTGGAAACCATCTCCCCAGGA<br>GACGGGCGCACCTTCCCCAAGCGCGGCCAGACCTGCGTGGTGC<br>ACTACACCGGGATGCTTGAAGATGGAAAGAAATTTGATTCCTC<br>CCGGGACAGAAACAAGCCCTTTAAGTTTATGCTAGGCAAGCA<br>GGAGGTGATCCGAGGCTGGGAAGAAGGGGTTGCCCAGATGAG<br>TGTGGGTCAGAGAGCCAAACTGACTATATCTCCAGATTATGCC<br>TATGGTGCCACTGGGCACCCAGGCATCATCCCACCACATGCCA<br>CTCTCGTCTTCGATGTGGAGCTTCTAAAACTGGAAGGCGGCCG<br>CGAGAGCAAGTACGGACCGCCCTGCCCACCTTGCCCTGCCCCC<br>GAGTTCCTGGGCGGACCCAGCGTGTTCCTGTTCCCACCCAAGC<br>CCAAGGACACCCTGATGATCAGCCGGACCCCCGAGGTGACCT<br>GCGTGGTGGTGGACGTGAGCCAGGAAGATCCCGAGGTCCAGT<br>TCAATTGGTACGTGGACGGCGTGGAAGTGCACAACGCCAAGA<br>CCAAGCCCAGAGAGGAACAGTTCAACAGCACCTACCGGGTGG<br>TGTCTGTGCTGACCGTGCTGCACCAGGACTGGCTGAACGGCAA<br>AGAATACAAGTGCAAGGTGTCCAACAAGGGCCTGCCCAGCAG<br>CATCGAAAAGACCATCAGCAAGGCCAAGGGCCAGCCTCGCGA<br>GCCCCAGGTGTACACCCTGCCTCCTCCCAGGAAGAGATGACC<br>AAGAACCAGGTGTCCCTGACCTGCCTGGTGAAGGGCTTCTACC<br>CCAGCGACATCGCCGTGGAGTGGGAGAGCAACGGCCAGCCTG<br>AGAACAACTACAAGACCACCCCTCCCGTGCTGGACAGCGACG |

TABLE 1-continued

Exemplary DARIC Binding and Signaling Components

| SEQ ID NO. | Construct | Sequence |
|---|---|---|
| | | GCAGCTTCTTCCTGTACAGCCGGCTGACCGTGGACAAGAGCCG<br>GTGGCAGGAAGGCAACGTCTTTAGCTGCAGCGTGATGCACGA<br>GGCCCTGCACAACCACTACACCCAGAAGAGCCTGAGCCTGTCC<br>CTGGGCAAGATGGCCCTGATTGTGCTGGGGGGCGTCGCCGGCC<br>TCCTGCTTTTCATTGGGCTAGGCATCTTCTTC |
| 59 | SS-CD19scFv-DmrA-CD52 GPI anchor protein | MPLGLLWLGLALLGALHAQAGSDIQMTQTTSSLSASLGDRVTISC<br>RASQDISKYLNWYQQKPDGTVKLLIYHTSRLHSGVPSRFSGSGSG<br>TDYSLTISNLEQEDIATYFCQQGNTLPYTFGGGTKLEITGSTSGSG<br>KPGSGEGSTKGEVKLQESGPGLVAPSQSLSVTCTVSGVSLPDYGV<br>SWIRQPPRKGLEWLGVIWGSETTYYN |
| 60 | SS-CD19scFv-DmrA-CD52 GPI anchor DNA | ATGCCCCTGGGCCTGCTGTGGCTGGGCCTGGCCCTGCTGGGCG<br>CCCTGCACGCCCAGGCCGGATCCGATATCCAGATGACCCAGAC<br>CACCAGCAGCCTGAGCGCCAGCCTGGGCGATAGAGTGACCAT<br>CAGCTGCAGAGCCAGCCAGGACATCAGCAAGTACCTGAACTG<br>GTATCAGCAGAAACCCGACGGCACCGTGAAGCTGCTGATCTAC<br>CACACCAGCAGACTGCACAGCGGCGTGCCCAGCAGATTTTCTG<br>GCAGCGGCTCCGGCACCGACTACAGCCTGACCATCTCCAACCT<br>GGAACAGGAAGATATCGCTACCTACTTCTGTCAGCAAGGCAAC<br>ACCCTGCCCTACACCTTCGGCGGAGGCACCAAGCTGGAAATCA<br>CCGGCAGCACAAGCGGCAGCGGCAAGCCTGGATCTGGCGAGG<br>GAAGCACCAAGGGCGAAGTGAAACTGCAGGAAAGCGGCCCTG<br>GACTGGTGGCCCCAAGCCAGTCTCTGAGCGTGACCTGTACCGT<br>GTCCGGCGTGTCCCTGCCTGACTATGGCGTGTCCTGGATCAGA<br>CAGCCACCCAGAAAGGGCCTGGAATGGCTGGGAGTGATCTGG<br>GGCAGCGAGACAACCTACTACAACAGCGCCCTGAAGTCCCGG<br>CTGACCATCATCAAGGACAACTCCAAGAGCCAGGTGTTCCTGA<br>AGATGAACAGCCTGCAGACCGACGACACCGCCATCTACTACTG<br>CGCCAAGCACTACTACTACGGCGGCAGCTACGCCATGGACTAC<br>TGGGGCCAGGGCACAAGCGTGACCGTGTCCAGCGCTAGCGGC<br>GGAGGTGGGAGCGGAGTGCAGGTGGAAACCATCTCCCCAGGA<br>GACGGGCGCACCTTCCCCAAGCGCGGCCAGACCTGCGTGGTGC<br>ACTACACCGGGATGCTTGAAGATGGAAAGAAATTTGATTCCTC<br>CCGGGACAGAAACAAGCCCTTTAAGTTTATGCTAGGCAAGCA<br>GGAGGTGATCCGAGGCTGGGAAGAAGGGGTTGCCCAGATGAG<br>TGTGGGTCAGAGAGCCAAACTGACTATATCTCCAGATTATGCC<br>TATGGTGCCACTGGGCACCCAGGCATCATCCCACCACATGCCA<br>CTCTCGTCTTCGATGTGGAGCTTCTAAAACTGGAAGGCGGCCG<br>CACCAGCCAAACCAGCAGCCCCTCAGCATCCAGCAACATAAG<br>CGGAGGCATTTTCCTTTTCTTCGTGGCCAATGCCATAATCCACC<br>TCTTCTGCTTCAGT |
| 64 | CD8ss-DmrC-CD8TM-41BB-CD3z-P2A-IgKss-CD19scFv-DmrA-CD4TM protein | MALPVTALLLPLALLLHAARPGSILWHEMWHEGLEEASRLYFGE<br>RNVKGMFEVLEPLHAMMERGPQTLKETSFNQAYGRDLMEAQE<br>WCRKYMKSGNVKDLLQAWDLYYHVFRRISKASAGTGSDIYIWA<br>PLAGTCGVLLLSLVITMHKRGRKKLLYIFKQPFMRPVQTTQEEDG<br>CSCRFPEEEEGGCELRVKFSRSADAPAYQQGQNQLYNELNLGRR<br>EEYDVLDKRRGRDPEMGGKPRRKNPQEGLYNELQKDKMAEAYS<br>EIGMKGERRRGKGHDGLYQGLSTATKDTYDALHMQALPPRSGS<br>GATNFSLLKQAGDVEENPGPSMETDTLLLWVLLLWVPGSTGSDI<br>QMTQTTSSLSASLGDRVTISCRASQDISKYLNWYQQKPDGTVKLL<br>IYHTSRLHSGVPSRFSGSGSGTDYSLTISNLEQEDIATYFCQQGNTL<br>PYTFGGGTKLEITGSTSGSGKPGSGEGSTKGEVKLQESGPGLVAPS<br>QSLSVTCTVSGVSLPDYGVSWIRQPPRKGLEWLGVIWGSETTYY<br>NSALKSRLTIIKDNSKSQVFLKMNSLQTDDTAIYYCAKHYYYGGS<br>YAMDYWGQGTSVTVSSASGGGGSGVQVETISPGDGRTFPKRGQT<br>CVVHYTGMLEDGKKFDSSRDRNKPFKFMLGKQEVIRGWEEGVA<br>QMSVGQRAKLTISPDYAYGATGHPGIIPPHATLVFDVELLKLEGG<br>RMALIVLGGVAGLLLFIGLIFFCVRCRHRRRQ |
| 65 | CD8ss-DmrC-CD8TM-41BB-CD3z-P2A-IgKss-CD19scFv-DmrA-CD4TM DNA | ATGGCTCTGCCTGTGACAGCTCTGCTGCTGCCTCTGGCCCTGCT<br>GCTCCATGCCGCCAGACCCGGATCCATCCTCTGGCATGAGATG<br>TGGCATGAAGGCCTGGAAGAGGCATCTCGTTTGTACTTTGGGG<br>AAAGGAACGTGAAAGGCATGTTTGAGGTGCTGGAGCCCTTGC<br>ATGCTATGATGGAACGGGGCCCCCAGACTCTGAAGGAAACAT<br>CCTTTAATCAGGCCTATGGTCGAGATTTAATGGAGGCCCAAGA<br>GTGGTGCAGGAAGTACATGAAATCAGGGAATGTCAAGGACCT<br>CCTCCAAGCCTGGGACCTCTATTATCATGTGTTCCGACGAATCT<br>CAAAGGCTAGCGCCGGCACTGGTTCCGACATCTACATCTGGGC<br>CCCTCTGGCCGGCACATGTGGCGTGCTGCTGCTGAGCCTCGTG<br>ATCACCATGCATAAACGGGGCAGAAAGAAACTCCTGTATATAT<br>TCAAACAACCATTTATGAGACCAGTACAAACTACTCAAGAGG<br>AAGATGGCTGTAGCTGCCGATTTCCAGAAGAAGAAGAAGGAG<br>GATGTGAACTGCGGGTGAAGTTCAGCAGAAGCGCCGACGCCC |

TABLE 1-continued

Exemplary DARIC Binding and Signaling Components

| SEQ ID NO. | Construct | Sequence |
|---|---|---|
| | | CTGCCTACCAGCAGGGCCAGAATCAGCTGTACAACGAGCTGA<br>ACCTGGGCAGAAGGGAAGAGTACGACGTCCTGGATAAGCGGA<br>GAGGCCGGGACCCTGAGATGGGCGGCAAGCCTCGGCGGAAGA<br>ACCCCCAGGAAGGCCTGTATAACGAACTGCAGAAAGACAAGA<br>TGGCCGAGGCCTACAGCGAGATCGGCATGAAGGGCGAGCGGA<br>GGCGGGGCAAGGGCCACGACGGCCTGTATCAGGGCCTGTCCA<br>CCGCCACCAAGGATACCTACGACGCCCTGCACATGCAGGCCCT<br>GCCCCCAAGGTCAGGATCTGGCGCCACGAACTTCTCTCTGTTA<br>AAGCAAGCAGGAGATGTTGAAGAAAACCCCGGGCCTTCAATG<br>GAGACAGACACACTCCTGCTATGGGTACTGCTGCTCTGGGTTC<br>CAGGTTCCACTGGTTCCGATATCCAGATGACCCAGACCACCAG<br>CAGCCTGAGCGCCAGCCTGGGCGATAGAGTGACCATCAGCTG<br>CAGAGCCAGCCAGGACATCAGCAAGTACCTGAACTGGTATCA<br>GCAGAAACCCGACGGCACCGTGAAGCTGCTGATCTACCACAC<br>CAGCAGACTGCACAGCGGCGTGCCCAGCAGATTTTCTGGCAGC<br>GGCTCCGGCACCGACTACAGCCTGACCATCTCCAACCTGGAAC<br>AGGAAGATATCGCTACCTACTTCTGTCAGCAAGGCAACACCCT<br>GCCCTACACCTTCGGCGAGGCACCAAGCTGGAAATCACCGG<br>CAGCACAAGCGGCAGCGGCAAGCCTGGATCTGGCGAGGGAAG<br>CACCAAGGGCGAAGTGAAACTGCAGGAAAGCGGCCCTGGACT<br>GGTGGCCCCAAGCCAGTCTCTGAGCGTGACCTGTACCGTGTCC<br>GGCGTGTCCCTGCCTGACTATGGCGTGTCCTGGATCAGACAGC<br>CACCCAGAAAGGGCCTGGAATGGCTGGGAGTGATCTGGGGCA<br>GCGAGACAACCTACTACAACAGCGCCCTGAAGTCCCGGCTGA<br>CCATCATCAAGGACAACTCCAAGAGCCAGGTGTTCCTGAAGAT<br>GAACAGCCTGCAGACCGACGACACCGCCATCTACTACTGCGCC<br>AAGCACTACTACTACGGCGGCAGCTACGCCATGGACTACTGGG<br>GCCAGGGCACAAGCGTGACCGTGTCCAGCGCTAGCGGCGGAG<br>GTGGGAGCGGAGTGCAGGTGGAAACCATCTCCCCAGGAGACG<br>GGCGCACCTTCCCCAAGCGCGGCCAGACCTGCGTGGTGCACTA<br>CACCGGGATGCTTGAAGATGGAAAGAAATTTGATTCCTCCCGG<br>GACAGAAACAAGCCCTTTAAGTTTATGCTAGGCAAGCAGGAG<br>GTGATCCGAGGCTGGGAAGAAGGGGTTGCCCAGATGAGTGTG<br>GGTCAGAGAGCCAAACTGACTATATCTCCAGATTATGCCTATG<br>GTGCCACTGGGCACCCAGGCATCATCCCACCACATGCCACTCT<br>CGTCTTCGATGTGGAGCTTCTAAAACTGGAAGGCGGCCGCATG<br>GCCCTGATTGTGCTGGGGGGCGTCGCCGGCCTCCTGCTTTTCAT<br>TGGGCTAGGCATCTTCTTCTGTGTCAGGTGCCGGCACCGAAGG<br>CGCCAATAA |
| 67 | CD8ss-DmrC-CD8TM-<br>41BB-CD3z-P2A-<br>IgKss-CD19scFv-<br>DmrA-CD4TM codon<br>optimized protein | MALPVTALLLPLALLLHAARPGSILWHEMWHEGLEEASRLYFGE<br>RNVKGMFEVLEPLHAMMERGPQTLKETSFNQAYGRDLMEAQE<br>WCRKYMKSGNVKDLLQAWDLYYHVFRRISKASAGTGSDIYIWA<br>PLAGTCGVLLLSLVITMHKRGRKKLLYIFKQPFMRPVQTTQEEDG<br>CSCRFPEEEEGGCELRVKFSRSADAPAYQQGQNQLYNELNLGRR<br>EEYDVLDKRRGRDPEMGGKPRRKNPQEGLYNELQKDKMAEAYS<br>EIGMKGERRRGKGHDGLYQGLSTATKDTYDALHMQALPPRSGS<br>GATNFSLLKQAGDVEENPGPSMETDTLLLWVLLLWVPGSTGDIQ<br>MTQTTSSLSASLGDRVTISCRASQDISKYLNWYQQKPDGTVKLLI<br>YHTSRLHSGVPSRFSGSGSGTDYSLTISNLEQEDIATYFCQQGNTL<br>PYTFGGGTKLEITGSTSGSGKPGSGEGSTKGEVKLQESGPGLVAPS<br>QSLSVTCTVSGVSLPDYGVSWIRQPPRKGLEWLGVIWGSETTYY<br>NSALKSRLTIIKDNSKSQVFLKMNSLQTDDTAIYYCAKHYYYGGS<br>YAMDYWGQGTSVTVSSPRGGGGSGVQVETISPGDGRTFPKRGQT<br>CVVHYTGMLEDGKKFDSSRDRNKPFKFMLGKQEVIRGWEEGVA<br>QMSVGQRAKLTISPDYAYGATGHPGIIPPHATLVFDVELLKLEGG<br>RMALIVLGGVAGLLLFIGLGIFFCVRCRHRRRQ |
| 68 | CD8ss-DmrC-CD8TM-<br>41BB-CD3z-P2A-<br>IgKss-CD19scFv-<br>DmrA-CD4TM codon<br>optimized DNA | ATGGCCCTCCCTGTGACCGCCCTGCTGCTCCCCCTCGCCCTGTT<br>GCTCCATGCTGCCCGACCTGGATCCATCCTTTGGCACGAGATG<br>TGGCACGAGGGACTCGAAGAAGCGTCCCGGCTGTACTTCGGA<br>GAGCGGAACGTGAAGGGGATGTTCGAAGTGCTGGAACCCCTG<br>CACGCCATGATGGAGCGGGGTCCTCAGACCCTTAAAGAAACA<br>AGCTTCAACCAGGCGTACGGGCGCGACCTGATGGAAGCCCAG<br>GAGTGGTGCCGCAAGTACATGAAGTCCGGAAACGTGAAGGAT<br>CTGCTGCAAGCCTGGGATCTGTACTACCACGTGTTCAGAAGGA<br>TCTCAAAGGCTAGCGCCGGCACTGGTTCGGATATCTACATTTG<br>GGCACCGCTCGCCGGCACTTGTGGAGTGCTGTTGCTGTCCCTC<br>GTGATCACCATGCATAAGAGGGGACGGAAGAAGCTGCTGTAC<br>ATTTTCAAGCAGCCATTCATGCGGCCTGTGCAAACCACCCAGG<br>AGGAGGACGGGTGCAGCTGCCGGTTCCCTGAGGAAGAGGAGG<br>GCGGATGCGAACTGCGCGTGAAGTTCAGCCGGAGCGCAGATG<br>CTCCCGCATACCAACAGGGACAGAACCAGCTGTATAACGAGC<br>TGAACCTGGGCAGAAGGGAAGAGTACGACGTCCTCGACAAGC<br>GGCGGGGACGCGACCCAGAAATGGGAGGAAAGCCCCGCCGGA |

TABLE 1-continued

Exemplary DARIC Binding and Signaling Components

| SEQ ID NO. | Construct | Sequence |
|---|---|---|
| | | AGAACCCGCAGGAAGGCCTGTACAACGAGTTGCAGAAAGACA AGATGGCTGAAGCTTACTCGGAGATTGGCATGAAGGGGGAGA GAAGAAGAGGGAAGGGCCACGACGGCCTTTACCAAGGACTGA GCACTGCCACCAAGGACACCTACGATGCGCTGCACATGCAGG CCCTGCCCCCGCGGTCCGGTTCGGGCGCGACTAACTTCAGCCT GCTGAAGCAGGCCGGAGATGTGGAGGAAAACCCTGGACCGTC CATGGAGACTGATACCCTGCTTCTGTGGGTCCTGCTCCTCTGG GTGCCGGGCTCCACCGGTGACATCCAGATGACCCAGACCACCT CATCCCTGAGCGCCTCTCTGGGTGATCGCGTGACTATCTCCTGC CGGGCGTCGCAGGATATCTCCAAGTACCTGAACTGGTACCAGC AAAAACCGGACGGGACCGTGAAACTGCTGATCTACCATACTTC CCGCCTTCATTCCGGAGTGCCCTCCCGGTTTTCCGGCTCGGGTT CAGGGACTGATTATTCGCTGACCATTTCCAACCTGGAGCAGGA GGACATTGCGACCTACTTCTGCCAACAAGGAAACACCCTGCCC TACACTTTCGGTGGTGGAACCAAGCTCGAGATCACCGGATCAA CCTCGGGCAGCGGGAAGCCGGGCAGCGGAGAGGGATCGACGA AAGGAGAAGTCAAGCTGCAGGAATCCGGCCCGGGACTGGTGG CCCCGAGCCAGTCGCTCTCCGTCACTTGCACCGTGTCGGGAGT GTCCTTGCCCGACTACGGAGTGTCATGGATTCGGCAGCCACCT CGCAAGGGCCTGGAATGGCTCGGCGTGATTTGGGGCTCAGAA ACCACATACTACAACAGCGCCCTGAAGTCTCGGCTCACCATCA TCAAGGACAATTCCAAGTCCCAAGTGTTCCTGAAGATGAATAG CTTGCAGACTGACGACACCGCGATCTACTACTGTGCCAAGCAC TACTACTACGGCGGTTCCTACGCCATGGACTACTGGGGACAAG GAACTTCCGTGACTGTCTCCTCCCCTAGGGGGGGTGGTGGTTC GGGGGGTCCAGGTGGAAACCATTTCCCCCGGCGACGGGCGCAC CTTCCCGAAGCGCGGACAGACCTGTGTGGTGCACTATACCGGA ATGCTCGAAGATGGAAAGAAGTTTGACAGCTCCAGGGACCGC AACAAGCCTTTCAAGTTTATGCTTGGAAAGCAGGAAGTCATCC GGGGCTGGGAAGAGGGAGTCGCCCAGATGAGCGTCGGCCAGC GGGCCAAGCTGACGATCTCCCCTGACTATGCCTACGGCGCTAC CGGCCATCCCGGAATCATTCCGCCGCACGCAACCCTCGTGTTC GACGTGGAATTGCTCAAGCTGGAAGGCGGCCGCATGGCGCTG ATAGTGCTCGGCGGAGTGGCCGGACTGCTGCTGTTCATCGGCC TGGGCATCTTCTTCTGCGTGAGATGCCGCCATAGAAGGCGGCA ATGA |
| 70 | SS-DmrC-CD8TM-41BB-CD3z-P2A-SS-CD123scFv-DmrA-CD4TM protein | MRPTWAWWLFLVLLLALWAPARGGSILWHEMWHEGLEEASRL YFGERNVKGMFEVLEPLHAMMERGPQTLKETSFNQAYGRDLME AQEWCRKYMKSGNVKDLLQAWDLYYHVFRRISKASAGTGSDIY IWAPLAGTCGVLLLSLVITMHKRGRKKLLYIFKQPFMRPVQTTQE EDGCSCRFPEEEEGGCELRVKFSRSADAPAYQQGQNQLYNELNL GRREEYDVLDKRRGRDPEMGGKPRRKNPQEGLYNELQKDKMAE AYSEIGMKGERRRGKGHDGLYQGLSTATKDTYDALHMQALPPR GGRSGSGSGATNFSLLKQAGDVEENPGPSLWWRLWWLLLLLLLW PMVWAPRADYKDIVMTQSHKFMSTSVGDRVNITCKASQNVDSA VAWYQQKPGQSPKALIYSASYRYSGVPDRFTGRGSGTDFTLTISS VQAEDLAVYYCQQYYSTPWTFGGGTKLEIKRGGGGSGGGGSGG GGSGGGGSEVKLVESGGGLVQPGGSLSLSCAASGFTFTDYYMSW VRQPPGKALEWLALIRSKADGYTTEYSASVKGRFTLSRDDSQSIL YLQMNALRPEDSATYYCARDAAYYSYYSPEGAMDYWGQGTSV TVSSSASGGGGSGVQVETISPGDGRTFPKRGQTCVVHYTGMLED GKKFDSSRDRNKPFKFMLGKQEVIRGWEEGVAQMSVGQRAKLTI SPDYAYGATGHPGIIPPHATLVFDVELLKLEGGRMALIVLGGVAG LLLFIGLGIFFCVRCRHRRRQ |
| 71 | SS-DmrC-CD8TM-41BB-CD3z-P2A-SS-CD123scFv-DmrA-CD4TM DNA | ATGCGCCCCACCTGGGCCTGGTGGCTGTTCCTGGTGCTGCTGC TGGCCCTGTGGGCACCCGCTCGCGGCGGATCCATCCTCTGGCA TGAGATGTGGCATGAAGGCCTGGAAGAGGCATCTCGTTTGTAC TTTGGGGAAAGGAACGTGAAAGGCATGTTTGAGGTGCTGGAG CCCTTGCATGCTATGATGGAACGGGGCCCCCAGACTCTGAAGG AAACATCCTTTAATCAGGCCTATGGTCGAGATTTAATGGAGGC CCAAGAGTGGTGCAGGAAGTACATGAAATCAGGGAATGTCAA GGACCTCCTCCAAGCCTGGGACCTCTATTATCATGTGTTCCGA CGAATCTCAAAGGCTAGCGCCGGCACTGGTTCCGACATCTACA TCTGGGCCCCTCTGGCCGGCACATGTGGCGTGCTGCTGCTGAG CCTCGTGATCACCATGCATAAACGGGGCAGAAAGAAACTCCT GTATATATTCAAACAACCATTTATGAGACCAGTACAAACTACT CAAGAGGAAGATGGCTGTAGCTGCCGATTTCCAGAAGAAGAA GAAGGAGGATGTGAACTGCGGGTGAAGTTCAGCAGAAGCGCT GACGCCCCTGCCTACCAGCAGGGCCAGAATCAGCTGTACAAC GAGCTGAACCTGGGCAGAAGGGAAGAGTACGACGTCCTGGAT AAGCGGAGAGGCCGGGACCCTGAGATGGGCGGCAAGCCTCGG CGGAAGAACCCCCAGGAAGGCCTGTATAACGAACTGCAGAAA GACAAGATGGCCGAGGCCTACAGCGAGATCGGCATGAAGGGC |

TABLE 1-continued

Exemplary DARIC Binding and Signaling Components

| SEQ ID NO. | Construct | Sequence |
|---|---|---|
| | | GAGCGGAGGCGGGGCAAGGGCCACGACGGCCTGTATCAGGGC<br>CTGTCCACCGCCACCAAGGATACCTACGACGCCCTGCACATGC<br>AGGCCCTGCCCCCAAGGGGCGGCCGCTCAGGATCTGGCGCCA<br>CGAACTTCTCTCTGTTAAAGCAAGCAGGAGATGTTGAAGAAAA<br>CCCCGGGCCTTCACTGTGGTGGCGCCTGTGGTGGCTGCTCCTG<br>CTTCTGTTGCTCCTGTGGCCCATGGTGTGGGCCCCTAGGGCGG<br>ACTACAAAGATATTGTGATGACCCAGTCTCACAAATTCATGTC<br>CACATCAGTAGGAGACAGGGTCAACATCACCTGCAAGGCCAG<br>TCAGAATGTGGATAGTGCTGTAGCCTGGTATCAACAGAAACCA<br>GGGCAATCTCCTAAAGCACTGATTTACTCGGCATCCTACCGGT<br>ACAGTGGAGTCCCTGATCGCTTCACAGGCAGGGGATCTGGGAC<br>AGATTTCACTCTCACCATCAGCAGTGTGCAGGCTGAAGACCTG<br>GCAGTTTATTACTGTCAGCAATATTATAGCACTCCGTGGACGT<br>TCGGTGGAGGCACCAAGCTGGAAATCAAACGTGGTGGTGGTG<br>GTTCTGGTGGTGGTGGTTCTGGCGGCGGCGGCTCCGGTGGTGG<br>TGGATCCGAGGTGAAGCTGGTGGAGTCTGGAGGAGGCTTGGT<br>ACAGCCTGGGGGTTCTCTGAGTCTCTCCTGTGCAGCTTCTGGAT<br>TCACCTTCACTGATTACTACATGAGCTGGGTCCGCCAGCCTCC<br>AGGGAAGGCACTTGAGTGGTTGGCTTTGATTAGAAGCAAAGCT<br>GATGGTTACACAACAGAATACAGTGCATCTGTGAAGGGTCGGT<br>TCACCCTCTCCAGAGATGATTCCCAAAGCATCCTCTATCTTCAA<br>ATGAATGCCCTGAGACCTGAAGACAGTGCCACTTATTACTGTG<br>CAAGAGATGCGGCCTACTATAGTTACTATAGTCCCGAGGGGGC<br>TATGGACTACTGGGGTCAAGGAACCTCAGTCACCGTCTCCTCG<br>AGCGCTAGCGGCGGAGGTGGGAGCGGAGTGCAGGTGGAAACC<br>ATCTCCCCAGGAGACGGGCGCACCTTCCCCAAGCGCGGCCAG<br>ACCTGCGTGGTGCACTACACCGGGATGCTTGAAGATGGAAAG<br>AAATTTGATTCCTCCCGGGACAGAAACAAGCCCTTTAAGTTTA<br>TGCTAGGCAAGCAGGAGGTGATCCGAGGCTGGGAAGAAGGGG<br>TTGCCCAGATGAGTGTGGGTCAGAGAGCCAAACTGACTATATC<br>TCCAGATTATGCCTATGGTGCCACTGGGCACCCAGGCATCATC<br>CCACCACATGCCACTCTCGTCTTCGATGTGGAGCTTCTAAAAC<br>TGGAAGGCGGCCGCATGGCCCTGATTGTGCTGGGGGGCGTCGC<br>CGGCCTCCTGCTTTTCATTGGGCTAGGCATCTTCTTCTGTGTCA<br>GGTGCCGGCACCGAAGGCGCCAATAA |
| 78 | CD8ss.DmrC.CD8TM.<br>41BB.Zeta.P2A.IgKss.<br>CD19scFv.DmrA.CD154TM<br>codon optimized<br>protein | MALPVTALLLPLALLLHAARPGSILWHEMWHEGLEEASRLYFGE<br>RNVKGMFEVLEPLHAMMERGPQTLKETSFNQAYGRDLMEAQE<br>WCRKYMKSGNVKDLLQAWDLYYHVFRRISKASAGTGSDIYIWA<br>PLAGTCGVLLLSLVITMHKRGRKKLLYIFKQPFMRPVQTTQEEDG<br>CSCRFPEEEEGGCELRVKFSRSADAPAYQQGQNQLYNELNLGRR<br>EEYDVLDKRRGRDPEMGGKPRRKNPQEGLYNELQKDKMAEAYS<br>EIGMKGERRRGKGHDGLYQGLSTATKDTYDALHMQALPPRSGS<br>GATNFSLLKQAGDVEENPGPSMETDTLLLWVLLLWVPGSTGDIQ<br>MTQTTSSLSASLGDRVTISCRASQDISKYLNWYQQKPDGTVKLLI<br>YHTSRLHSGVPSRFSGSGSGTDYSLTISNLEQEDIATYFCQQGNTL<br>PYTFGGGTKLEITGSTSGSGKPGSGEGSTKGEVKLQESGPGLVAPS<br>QSLSVTCTVSGVSLPDYGVSWIRQPPRKGLEWLGVIWGSETTYY<br>NSALKSRLTIIKDNSKSQVFLKMNSLQTDDTAIYYCAKHYYYGGS<br>YAMDYWGQGTSVTVSSPRGGGGSGVQVETISPGDGRTFPKRGQT<br>CVVHYTGMLEDGKKFDSSRDRNKPFKFMLGKQEVIRGWEEGVA<br>QMSVGQRAKLTISPDYAYGATGHPGIIPPHATLVFDVELLKLEGG<br>RMKIFMYLLTVFLITQMIGSALFAVYLHRR |
| 80 | CD8ss.DmrC.CD8hinge-<br>TM.41BB.Zeta<br>protein | MALPVTALLLPLALLLHAARPGSILWHEMWHEGLEEASRLYFGE<br>RNVKGMFEVLEPLHAMMERGPQTLKETSFNQAYGRDLMEAQE<br>WCRKYMKSGNVKDLLQAWDLYYHVFRRISKASAKPTTTPAPRPP<br>TPAPTIASQPLSLRPEACRPAAGGAVHTRGLDFACDIYIWAPLAGT<br>CGVLLLSLVITMHKRGRKKLLYIFKQPFMRPVQTTQEEDGCSCRF<br>PEEEEGGCELRVKFSRSADAPAYQQGQNQLYNELNLGRREEYDV<br>LDKRRGRDPEMGGKPRRKNPQEGLYNELQKDKMAEAYSEIGMK<br>GERRRGKGHDGLYQGLSTATKDTYDALHMQALPPR |
| 82 | hScnSS.CD19scFv.DmrA<br>protein | MPLGLLWLGLALLGALHAQAGSDIQMTQTTSSLSASLGDRVTISC<br>RASQDISKYLNWYQQKPDGTVKLLIYHTSRLHSGVPSRFSGSGSG<br>TDYSLTISNLEQEDIATYFCQQGNTLPYTFGGGTKLEITGSTSGSG<br>KPGSGEGSTKGEVKLQESGPGLVAPSQSLSVTCTVSGVSLPDYGV<br>SWIRQPPRKGLEWLGVIWGSETTYYNSALKSRLTIIKDNSKSQVFL<br>KMNSLQTDDTAIYYCAKHYYYGGSYAMDYWGQGTSVTVSSAS<br>GGGGSGVQVETISPGDGRTFPKRGQTCVVHYTGMLEDGKKFDSS<br>RDRNKPFKFMLGKQEVIRGWEEGVAQMSVGQRAKLTISPDYAY<br>GATGHPGIIPPHATLVFDVELLKLEG |

TABLE 1-continued

Exemplary DARIC Binding and Signaling Components

| SEQ ID NO. | Construct | Sequence |
|---|---|---|
| 84 | hScnSS.CD20scFv.DmrA protein | MPLGLLWLGLALLGALHAQAGSEVQLQQSGAELVKPGASVKMS CKASGYTFTSYNMHWVKQTPGQGLEWIGAIYPGNGDTSYNQKF KGKATLTADKSSSTAYMQLSSLTSEDSADYYCARSNYYGSSYWF FDVWGAGTTVTVSSGSTSGGGSGGGSGGGGSSDIVLTQSPAILSA SPGEKVTMTCRASSSVNYMDWYQKKPGSSPKPWIYATSNLASGV PARFSGSGSGTSYSLTISRVEAEDAATYYCQQWSFNPPTFGGGTK LEIKASGGGGSGVQVETISPGDGRTFPKRGQTCVVHYTGMLEDG KKFDSSRDRNKPFKFMLGKQEVIRGWEEGVAQMSVGQRAKLTIS PDYAYGATGHPGIIPPHATLVFDVELLKLEG |
| 86 | CD8ss.FRB.CD8TM.41BB. Zeta.P2A.IgKss.CD19scFv. DmrA.CD4TM codon optimized protein | MALPVTALLLPLALLLHAARPGSILWHEMWHEGLEEASRLYFGE RNVKGMFEVLEPLHAMMERGPQTLKETSFNQAYGRDLMEAQE WCRKYMKSGNVKDLTQAWDLYYHVFRRISKASAGTGSDIYIWA PLAGTCGVLLLSLVITMHKRGRKKLLYIFKQPFMRPVQTTQEEDG CSCRFPEEEEGGCELRVKFSRSADAPAYQQGQNQLYNELNLGRR EEYDVLDKRRGRDPEMGGKPRRKNPQEGLYNELQKDKMAEAYS EIGMKGERRRGKGHDGLYQGLSTATKDTYDALHMQALPPRSGS GATNFSLLKQAGDVEENPGPSMETDTLLLWVLLLWVPGSTGDIQ MTQTTSSLSASLGDRVTISCRASQDISKYLNWYQQKPDGTVKLLI YHTSRLHSGVPSRFSGSGSGTDYSLTISNLEQEDIATYFCQQGNTL PYTFGGGTKLEITGSTSGSGKPGSGEGSTKGEVKLQESGPGLVAPS QSLSVTCTVSGVSLPDYGVSWIRQPPRKGLEWLGVIWGSETTYY NSALKSRLTIIKDNSKSQVFLKMNSLQTDDTAIYYCAKHYYYGGS YAMDYWGQGTSVTVSSPRGGGGSGVQVETISPGDGRTFPKRGQT CVVHYTGMLEDGKKFDSSRDRNKPFKFMLGKQEVIRGWEEGVA QMSVGQRAKLTISPDYAYGATGHPGIIPPHATLVFDVELLKLEGG RMALIVLGGVAGLLLFIGLGIFFCVRCRHRRRQ |
| 88 | CD8ss.FRB.CD8TM.41BB. Zeta.P2A.IgKss.CD19scFv. DmrA.CD154TM codon optimized protein | MALPVTALLLPLALLLHAARPGSILWHEMWHEGLEEASRLYFGE RNVKGMFEVLEPLHAMMERGPQTLKETSFNQAYGRDLMEAQE WCRKYMKSGNVKDLTQAWDLYYHVFRRISKASAGTGSDIYIWA PLAGTCGVLLLSLVITMHKRGRKKLLYIFKQPFMRPVQTTQEEDG CSCRFPEEEEGGCELRVKFSRSADAPAYQQGQNQLYNELNLGRR EEYDVLDKRRGRDPEMGGKPRRKNPQEGLYNELQKDKMAEAYS EIGMKGERRRGKGHDGLYQGLSTATKDTYDALHMQALPPRSGS GATNFSLLKQAGDVEENPGPSMETDTLLLWVLLLWVPGSTGDIQ MTQTTSSLSASLGDRVTISCRASQDISKYLNWYQQKPDGTVKLLI YHTSRLHSGVPSRFSGSGSGTDYSLTISNLEQEDIATYFCQQGNTL PYTFGGGTKLEITGSTSGSGKPGSGEGSTKGEVKLQESGPGLVAPS QSLSVTCTVSGVSLPDYGVSWIRQPPRKGLEWLGVIWGSETTYY NSALKSRLTIIKDNSKSQVFLKMNSLQTDDTAIYYCAKHYYYGGS YAMDYWGQGTSVTVSSPRGGGGSGVQVETISPGDGRTFPKRGQT CVVHYTGMLEDGKKFDSSRDRNKPFKFMLGKQEVIRGWEEGVA QMSVGQRAKLTISPDYAYGATGHPGIIPPHATLVFDVELLKLEGG RMKIFMYLLTVFLITQMIGSALFAVYLHRR |
| 90 | CD8ss.FRB.CD8hinge- TM.41BB.Zeta.P2A.IgKss. CD19scFv.DmrA. CD154TM codon optimized protein | MALPVTALLLPLALLLHAARPGSILWHEMWHEGLEEASRLYFGE RNVKGMFEVLEPLHAMMERGPQTLKETSFNQAYGRDLMEAQE WCRKYMKSGNVKDLTQAWDLYYHVFRRISKASAKPTTTPAPRPP TPAPTIASQPLSLRPEACRPAAGGAVHTRGLDFACDIYIWAPLAGT CGVLLLSLVITMHKRGRKKLLYIFKQPFMRPVQTTQEEDGCSCRF PEEEEGGCELRVKFSRSADAPAYQQGQNQLYNELNLGRREEYDV LDKRRGRDPEMGGKPRRKNPQEGLYNELQKDKMAEAYSEIGMK GERRRGKGHDGLYQGLSTATKDTYDALHMQALPPRSGSGATNFS LLKQAGDVEENPGPSMETDTLLLWVLLLWVPGSTGDIQMTQTTS SLSASLGDRVTISCRASQDISKYLNWYQQKPDGTVKLLIYHTSRL HSGVPSRFSGSGSGTDYSLTISNLEQEDIATYFCQQGNTLPYTFGG GTKLEITGSTSGSGKPGSGEGSTKGEVKLQESGPGLVAPSQSLSVT CTVSGVSLPDYGVSWIRQPPRKGLEWLGVIWGSETTYYNSALKS RLTIIKDNSKSQVFLKMNSLQTDDTAIYYCAKHYYYGGSYAMDY WGQGTSVTVSSPRGGGGSGVQVETISPGDGRTFPKRGQTCVVHY TGMLEDGKKFDSSRDRNKPFKFMLGKQEVIRGWEEGVAQMSVG QRAKLTISPDYAYGATGHPGIIPPHATLVFDVELLKLEGGRMKIF MYLLTVFLITQMIGSALFAVYLHRR |
| 92 | CD8ss.FRB.AMN.41BB. Zeta.P2A.IgKss.CD19scFv. DmrA.CD154TM codon optimized protein | MALPVTALLLPLALLLHAARPGSILWHEMWHEGLEEASRLYFGE RNVKGMFEVLEPLHAMMERGPQTLKETSFNQAYGRDLMEAQE WCRKYMKSGNVKDLTQAWDLYYHVFRRISKASVWGSSAAGLA GGVAAAVLLALLVLLVAPPLLMHKRGRKKLLYIFKQPFMRPVQT TQEEDGCSCRFPEEEEGGCELRVKFSRSADAPAYQQGQNQLYNE LNLGRREEYDVLDKRRGRDPEMGGKPRRKNPQEGLYNELQKDK MAEAYSEIGMKGERRRGKGHDGLYQGLSTATKDTYDALHMQAL PPRSGSGATNFSLLKQAGDVEENPGPSMETDTLLLWVLLLWVPG STGDIQMTQTTSSLSASLGDRVTISCRASQDISKYLNWYQQKPDG TVKLLIYHTSRLHSGVPSRFSGSGSGTDYSLTISNLEQEDIATYFCQ |

TABLE 1-continued

Exemplary DARIC Binding and Signaling Components

| SEQ ID NO. | Construct | Sequence |
|---|---|---|
| | | QGNTLPYTFGGGTKLEITGSTSGSGKPGSGEGSTKGEVKLQESGP<br>GLVAPSQSLSVTCTVSGVSLPDYGVSWIRQPPRKGLEWLGVIWGS<br>ETTYYNSALKSRLTIIKDNSKSQVFLKMNSLQTDDTAIYYCAKHY<br>YYGGSYAMDYWGQGTSVTVSSPRGGGGSGVQVETISPGDGRTFP<br>KRGQTCVVHYTGMLEDGKKFDSSRDRNKPFKFMLGKQEVIRGW<br>EEGVAQMSVGQRAKLTISPDYAYGATGHPGIIPPHATLVFDVELL<br>KLEGGRMKIFMYLLTVFLITQMIGSALFAVYLHRR |
| 96 | CD8ss.DmrC.CD8TM.<br>41BB.Zeta.P2A.IgKss.<br>CD19scFv.DmrA.CD71TM<br>codon optimized<br>protein | MALPVTALLLPLALLLHAARPGSILWHEMWHEGLEEASRLYFGE<br>RNVKGMFEVLEPLHAMMERGPQTLKETSFNQAYGRDLMEAQE<br>WCRKYMKSGNVKDLLQAWDLYYHVFRRISKASAGTGSDIYIWA<br>PLAGTCGVLLLSLVITMHKRGRKKLLYIFKQPFMRPVQTTQEEDG<br>CSCRFPEEEEGGCELRVKFSRSADAPAYQQGQNQLYNELNLGRR<br>EEYDVLDKRRGRDPEMGGKPRRKNPQEGLYNELQKDKMAEAYS<br>EIGMKGERRRGKGHDGLYQGLSTATKDTYDALHMQALPPRSGS<br>GATNFSLLKQAGDVEENPGPSMETDTLLLWVLLLWVPGSTGDIQ<br>MTQTTSSLSASLGDRVTISCRASQDISKYLNWYQQKPDGTVKLLI<br>YHTSRLHSGVPSRFSGSGSGTDYSLTISNLEQEDIATYFCQQGNTL<br>PYTFGGGTKLEITGSTSGSGKPGSGEGSTKGEVKLQESGPGLVAPS<br>QSLSVTCTVSGVSLPDYGVSWIRQPPRKGLEWLGVIWGSETTYY<br>NSALKSRLTIIKDNSKSQVFLKMNSLQTDDTAIYYCAKHYYYGGS<br>YAMDYWGQGTSVTVSSPRGGGGSGVQVETISPGDGRTFPKRGQT<br>CVVHYTGMLEDGKKFDSSRDRNKPFKFMLGKQEVIRGWEEGVA<br>QMSVGQRAKLTISPDYAYGATGHPGIIPPHATLVFDVELLKLEGG<br>RRCSGSICYGTIAVIVFFLIGFMIGYLGY |
| 98 | CD8ss.DmrC.CD8TM.<br>41BB.Zeta.P2A.CD71TM.<br>DmrA.CD19scFv<br>codon optimized<br>protein | MALPVTALLLPLALLLHAARPGSILWHEMWHEGLEEASRLYFGE<br>RNVKGMFEVLEPLHAMMERGPQTLKETSFNQAYGRDLMEAQE<br>WCRKYMKSGNVKDLLQAWDLYYHVFRRISKASAGTGSDIYIWA<br>PLAGTCGVLLLSLVITMHKRGRKKLLYIFKQPFMRPVQTTQEEDG<br>CSCRFPEEEEGGCELRVKFSRSADAPAYQQGQNQLYNELNLGRR<br>EEYDVLDKRRGRDPEMGGKPRRKNPQEGLYNELQKDKMAEAYS<br>EIGMKGERRRGKGHDGLYQGLSTATKDTYDALHMQALPPRSGS<br>GATNFSLLKQAGDVEENPGPSRCSGSICYGTIAVIVFFLIGFMIGYL<br>GYTGGVQVETISPGDGRTFPKRGQTCVVHYTGMLEDGKKFDSSR<br>DRNKPFKFMLGKQEVIRGWEEGVAQMSVGQRAKLTISPDYAYG<br>ATGHPGIIPPHATLVFDVELLKLEGGGGSPRDIQMTQTTSSLSASL<br>GDRVTISCRASQDISKYLNWYQQKPDGTVKLLIYHTSRLHSGVPS<br>RFSGSGSGTDYSLTISNLEQEDIATYFCQQGNTLPYTFGGGTKLEI<br>TGSTSGSGKPGSGEGSTKGEVKLQESGPGLVAPSQSLSVTCTVSG<br>VSLPDYGVSWIRQPPRKGLEWLGVIWGSETTYYNSALKSRLTIIK<br>DNSKSQVFLKMNSLQTDDTAIYYCAKHYYYGGSYAMDYWGQG<br>TSVTVSS |
| 100 | CD8ss.FRB.CD8Hinge.<br>CD8TM.41BB.Zeta.P2A.<br>IgKss.CD19scFv.DmrA<br>codon optimized<br>protein | MALPVTALLLPLALLLHAARPGSILWHEMWHEGLEEASRLYFGE<br>RNVKGMFEVLEPLHAMMERGPQTLKETSFNQAYGRDLMEAQE<br>WCRKYMKSGNVKDLTQAWDLYYHVFRRISKASAKPTTTPAPRPP<br>TPAPTIASQPLSLRPEACRPAAGGAVHTRGLDFACDIYIWAPLAGT<br>CGVLLLSLVITMHKRGRKKLLYIFKQPFMRPVQTTQEEDGCSCRF<br>PEEEEGGCELRVKFSRSADAPAYQQGQNQLYNELNLGRREEYDV<br>LDKRRGRDPEMGGKPRRKNPQEGLYNELQKDKMAEAYSEIGMK<br>GERRRGKGHDGLYQGLSTATKDTYDALHMQALPPRSGSGATNFS<br>LLKQAGDVEENPGPSMETDTLLLWVLLLWVPGSTGDIQMTQTTS<br>SLSASLGDRVTISCRASQDISKYLNWYQQKPDGTVKLLIYHTSRL<br>HSGVPSRFSGSGSGTDYSLTISNLEQEDIATYFCQQGNTLPYTFGG<br>GTKLEITGSTSGSGKPGSGEGSTKGEVKLQESGPGLVAPSQSLSVT<br>CTVSGVSLPDYGVSWIRQPPRKGLEWLGVIWGSETTYYNSALKS<br>RLTIIKDNSKSQVFLKMNSLQTDDTAIYYCAKHYYGGSYAMDY<br>WGQGTSVTVSSPRGGGGSGVQVETISPGDGRTFPKRGQTCVVHY<br>TGMLEDGKKFDSSRDRNKPFKFMLGKQEVIRGWEEGVAQMSVG<br>QRAKLTISPDYAYGATGHPGIIPPHATLVFDVELLKLE |

EXAMPLES

Example 1

Construction of DARIC Binding and Signaling Components

The DARIC binding and signaling components were each separately cloned into a plasmid vector containing a T7 promoter, a hScn or hCD8 secretion signal, respectively, and a downstream linearization site. Linearized plasmids were then used as templates for in vitro transcription reactions, followed by 3'-polyadenylation and 5'-capping steps to create mature in vitro transcribed mRNA (IVT-mRNA) to be electroporated into primary human T cells. Human T cells were isolated from PBMCs by negative selection using paramagnetic beads and expanded with anti-CD3/anti-CD28 beads for 48 hours prior to electroporation. Control electroporations using IVT-mRNA encoding fluorescent proteins were performed in parallel to confirm transfection efficiency, or 2A protein-linked fluorescent proteins were incorporated directly into the DARIC component mRNA species.

Exemplary IVT-mRNA encoding binding components (scFv specific for CD19 and multimerization domain FKBP12 ("DmrA"), FKBP12 F36V ("DmrB"), FRB (2021-2113) T2098L ("DmrC")) are provided in SEQ ID NOs.:2, 5, and 8 (scFv specific for CD19 and multimerization domain FKBP12, FKBP12 F36V, or FRB (2021-2113) T2098L, respectively). Exemplary IVT-mRNA encoding signaling components are provided in SEQ ID NOs.:16, 20, and 24 (multimerization domain FRB (2021-2113) T2098L, FKBP12 F36V, or FKBP12, respectively, transmembrane domain, 4-1BB, and CD3ζ).

Multimerization is promoted with a bridging factor, such as rapamycin or rapalogs thereof, or gibberellin or derivatives thereof. Rapamycin and its derivatives (e.g., AP21967, also known as C-16-(S)-7-methylindolerapamycin, $IC_{50}=10$ nM, a chemically modified non-immunosuppressive rapamycin analogue) can induce heterodimerization of FKBP12 and FRB-containing fusion proteins. AP1903 or AP20187 are homo-bivalent drugs based on the FKBP12-interacting component of rapamycin, which can be used in homodimerization scenarios described herein.

Example 2

Cytotoxicity of T Cells Encoding DARIC Components

Recombinant T cells expressing the two DARIC components were incubated with K562 target cells (a human myeloid leukemia cell line), which were modified to express either CD19 or CD20 antigen, to examine target cell lysis. Briefly, T cells were co-incubated with a 50:50 mixture of K562-CD19 and K562-CD20 target cell lines, at 3:1 or 10:1 T cell to target cell ratios. In experimental samples, 500 nM final concentration of the hetero-bivalent rapalog AP21967 was added. The relative percentage of each of the target cell lines was monitored by flow cytometry staining for the CD19 and CD20 antigens to evaluate cell lysis (see FIG. 3).

Figure 3A:
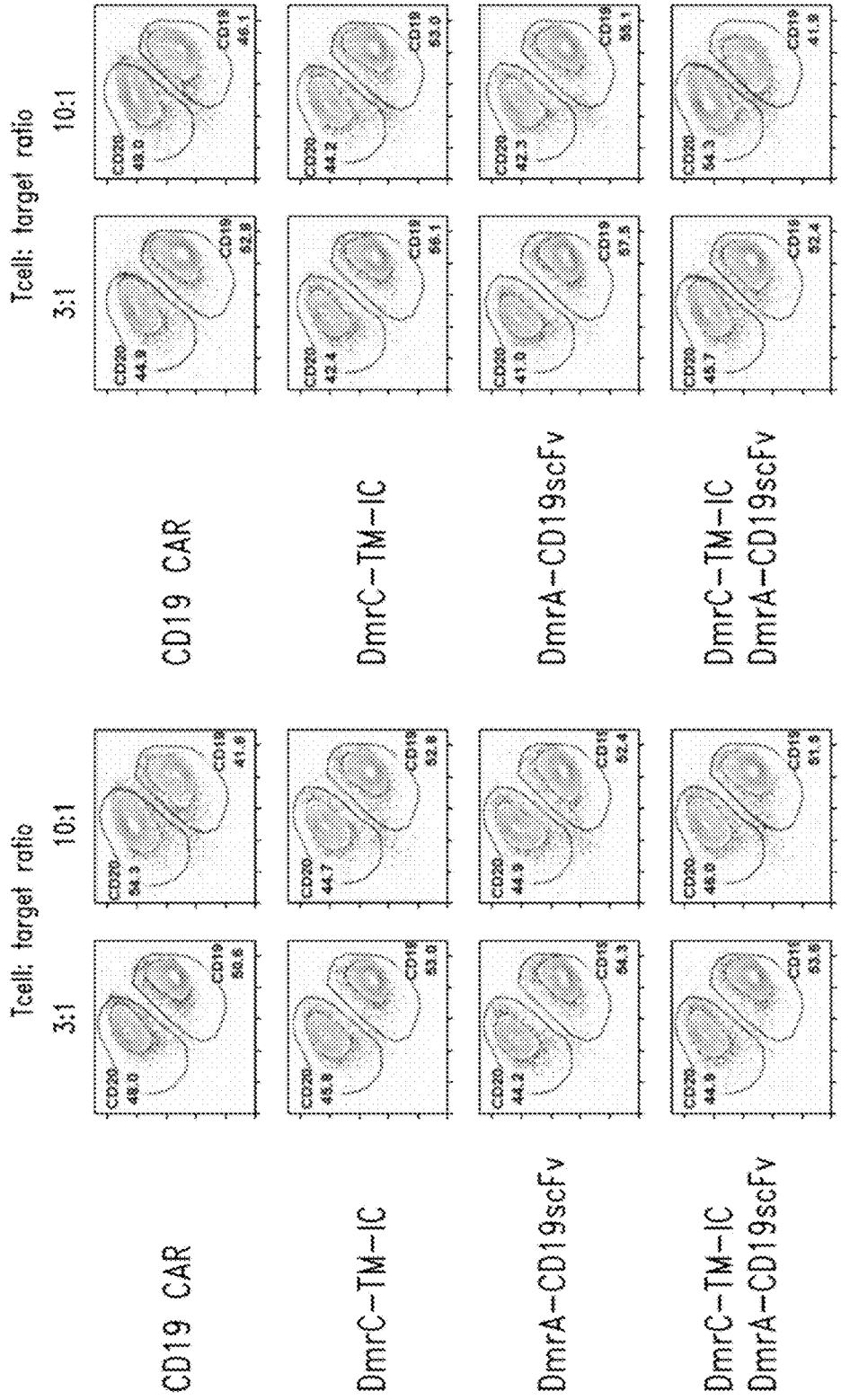
FIGS. 3A and 3B show the cytotoxic properties of human T cells expressing a multipartite signaling complex of this disclosure.

Four samples of primary human T cells were prepared by electroporation with IVT-mRNA encoding (i) an extensively validated single-chain chimeric antigen receptor (CAR) (CD19-CAR, SEQ ID NO.:14, positive control); (ii) the DARIC signaling component only (DSC, SEQ ID NO.:16, negative control); iii) the DARIC binding component only (DBC-CD19, SEQ ID NO.:2, negative control); and (iv) both DARIC binding and signaling components (DSC, SEQ ID NO.:16 plus DBC-CD19, SEQ ID NO.:2). The relative percentages of each of the target cell lines were monitored by flow cytometry staining for the CD19 and CD20 antigens (FIG. 3A).

Figure 3B:
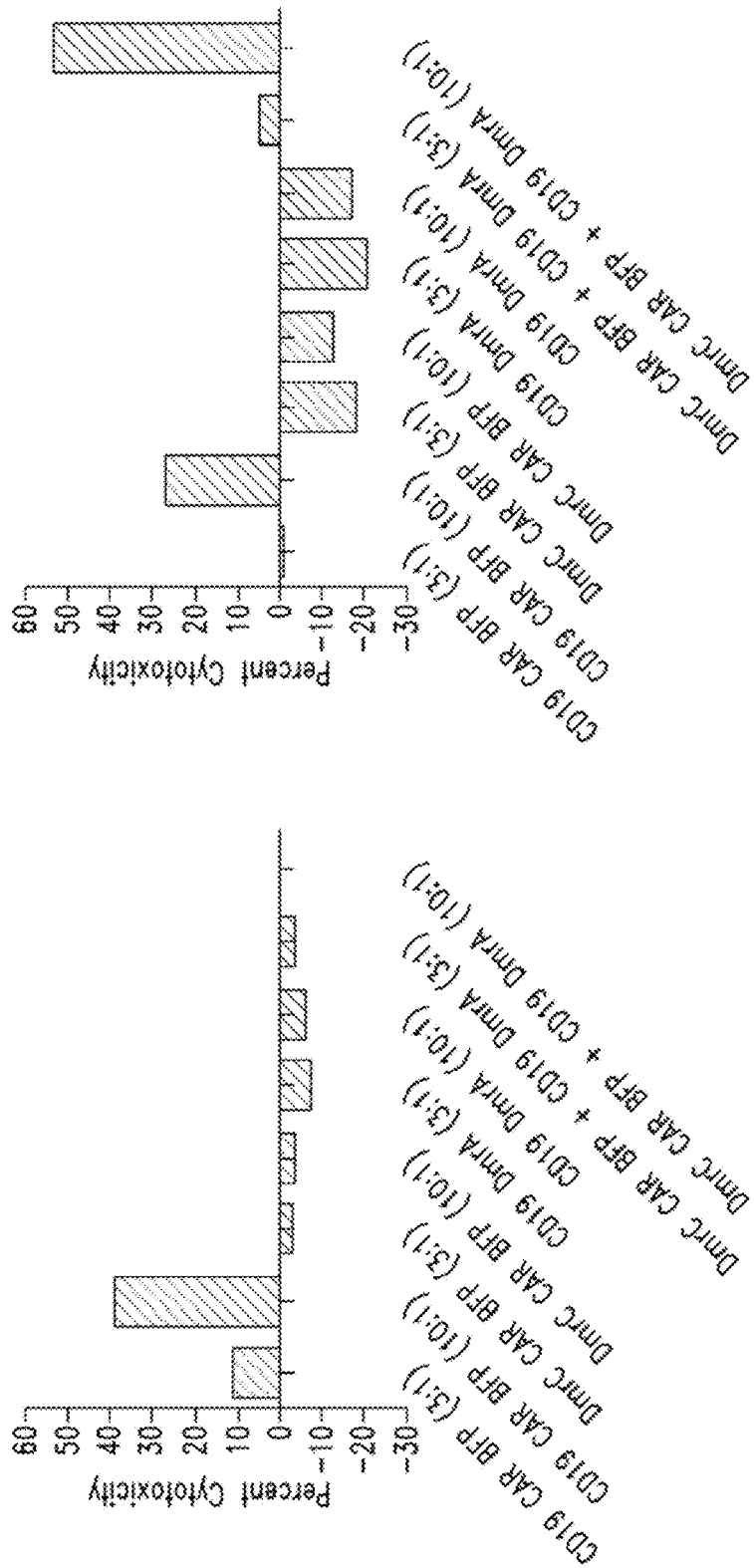

The percent specific cytotoxicity was calculated for each condition as the percentage change relative the input K562-CD19:K562-CD20 ratio. T cells expressing the validated CD19-CAR (SEQ ID NO.:14) showed substantial cytotoxicity and skewing of the ratio of CD19 versus CD20 cells in the live cell gate, particularly at a 10:1 T cell to target cell ratio. The T cells expressing the DARIC binding component alone, DARIC signaling component alone, or both DARIC components but without the addition of the hetero-bivalent rapalog AP21967, showed no significant cytotoxicity. In the presence of AP21967, a substantial specific cytotoxicity and loss of the K562-CD19 target cells was observed upon co-incubation with T cells expressing both DARIC components (FIG. 3B).

These results indicate that the DARIC mechanism can reconstitute antigen-specific target cell lysis. Furthermore, the DARIC design enables pharmacological control of antigen-specific T cell cytotoxicity.

Example 3

Cytokine Secretion Profile of T Cells Encoding DARIC Components

Figure 4:
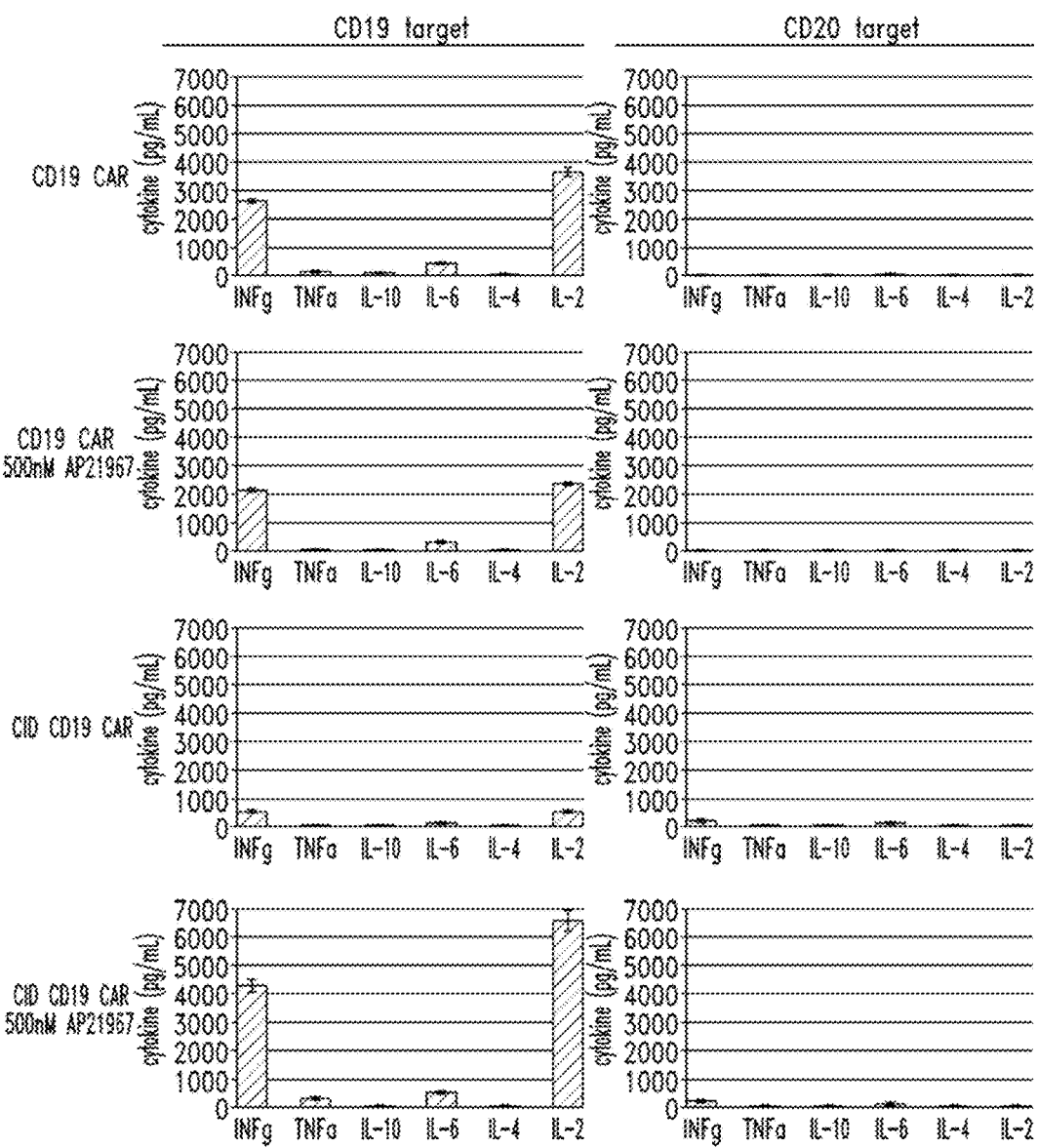
FIG. 4 shows the cytokine secretion profile of human T cells expressing a multipartite signaling complex of this disclosure.

Recombinant T cells expressing the two DARIC components were incubated with K562 target cells (a human myeloid leukemia cell line), which were modified to express either CD19 or CD20 antigen, to examine cytokine expression. Briefly, IVT-mRNA transfected T cells were co-incubated with either the K562-CD19 or K562-CD20 cell lines using T cell to target ratios of 1:1, with or without the addition of 500 nM AP21967. Supernatants were isolated for analysis of cytokine production (see FIG. 4).

Two samples of primary human T cells were isolated, expanded, and then prepared by electroporation with IVT-mRNA encoding either (i) the validated single-chain CAR (CD19-CAR, SEQ ID NO.:13, positive control); or (ii) both DARIC binding and signaling components (DSC, SEQ ID NO.:16 plus DBC-CD19, SEQ ID NO.:2). After extensively washing the expanded and electroporated T cells to remove residual cytokines from the growth media, the T cells were co-incubated with K562 cell lines expressing either the human CD19 antigen (left panels) or the CD20 antigen (right panels) at 1:1 T cell to target cell ratios and in the presence or absence of the AP21967 rapalog. The supernatants were then collected and assayed for analyte concentrations using cytokine capture antibody-labeled beads (Becton Dickenson Cytokine Bead Array, human Th1/Th2 kit). Comparison with recombinant protein standards enabled calculation of absolute concentrations of each of the six cytokines encompassed by the bead array.

Consistent with previous cytotoxicity findings, T cells expressing the positive control CD19-CAR produced substantial amounts of interferon-gamma (IFNγ) and interleukin-2 (IL-2) when co-incubated with CD19 expressing K562 target cells. T cells expressing the DARIC components in the absence of bridging factor AP21967 showed no significant cytokine production, but in the presence of AP21967 produced IFNγ and IL-2 at levels equivalent, or superior, to the single chain CD19-CAR positive control.

Example 4

Lentiviral Delivery of DARIC Components

Primary human T cells were isolated, activated, and then transduced with lentiviral vectors encoding DARIC binding and signaling components (SEQ ID NOS.:44 and 47). The transduced T cells were then co-incubated with about a 50:50 mixture of the K562 target cells expressing either CD19 (K562-CD19) or CD20 (K562-CD20) to evaluate antigen-specific cytotoxicity. The overall ratio of T cells to K562 cells was 5:1 in all samples. In control samples, no bridging factor was added, whereas in experimental samples either rapamycin (10 nM) or AP21967 (100 nM) were applied as the bridging factor for the secreted antigen binding component and the signaling component (see, e.g., FIG. 1B). The DARIC antigen binding component includes a CD19 antigen binding scFv domain and a FKBP12 multimerization domain, which was linked to a mCherry fluorescent protein. Two independent multimerization domains having different specificities for bridging components were tested on the DARIC signaling component: FRB, which is responsive to rapamycin, and the FRB (2021-2113) T2098L variant, which is responsive to both rapamycin and AP21967, each linked to the blue fluorescent protein (BFP).

Flow cytometric analysis of the lentivirus-transduced T cells demonstrated expression of both mCherry and BFP proteins simultaneously, indicating both DARIC components were being expressed within the same cells (see FIG. 5, first column for each treatment). Flow cytometric analysis of the K562 cells demonstrated rapamycin and AP21967-dependent elimination of the CD19 expressing K562 cells in the sample expressing variant FRB (2021-2113) T2098L multimerization domain, whereas no addition of a bridging factor had no effect on cell survival (see FIG. 5, top row of second column for each treatment). But, only rapamycin was able to activate the elimination of the K562-CD19 cells by T cells expressing the FRB dimerization domain, while AP21967 or no addition of a bridging factor had no effect on cell survival (see FIG. 5, second row of second column for each treatment). These data show the specificity of cytotoxic activity that can be achieved with the DARIC multipartite component system.

In addition, two distinct T cell populations were mixed, wherein one population was expressing a DARIC antigen binding component and the other population was expressing a DARIC signaling component. This mixed cell population, when co-cultured with the CD19 and CD20 expressing K562 cells, showed a rapamycin-dependent cytotoxicity response against K562-CD19 cells, while the absence of a bridging factor had no effect on target cell survival (see FIG. 5, bottom row). These data indicate that a DARIC antigen binding component expressed by one T cell population can act in trans with a different population of T cells that express a DARIC signaling component and attack the target cells.

The flexibility of the DARIC system was validated by swapping the multimerization domains such that the DARIC binding component targeting CD19 comprised the FRB based DmrC domain and the DARIC signaling component comprised the FKBP12 based DmrA domain (SEQ ID NOs.:12, 31). Primary human T cells were made to express the 'swapped' DARIC components and then co-incubated with 50:50 mixtures of the K562-CD19 and C562-CD20 target cells either in the absence or presence of the indicated concentrations of rapamycin (FIG. 10). Antigen specific cytotoxicity was observed in the experimental samples containing the bridging factor, but absent from the control sample lacking rapamycin. These data demonstrate that the architecture of the DARIC system is flexible and amenable to a variety of multimerization domain orientations.

Example 5

Titration of Bridging Factors to Sub-Therapeutic Levels

A broad range of bridging factor (rapamycin and everolimus) concentrations were tested to determine whether a DARIC system can function at clinically relevant concentrations. As in the Example 4, primary human T cells were isolated, activated, and then transduced with lentiviral vectors expressing a DARIC binding component (SEQ ID NOS.:1, 4, 7) and a DARIC signaling component (SEQ ID NOS.:15, 19, 23). The DARIC expressing T cells were then co-incubated with 50:50 mixtures of the K562-CD19 and K562-CD20 target cells to evaluate antigen-specific cytotoxicity. The overall ratio of T cells to K562 cells was 5:1 in all samples.

The indicated concentrations of rapamycin and everolimus were added to the co-culture samples and then the cytotoxicity responses were evaluated by flow cytometry (FIG. 6). Cytotoxicity responses were maintained to sub-nanomolar drug concentrations, well below the steady state concentrations of rapamycin and everolimus that are presently achieved when these drugs are administered to patients in the clinic.

Example 6

Use of a Tethered DARIC Binding Component

Figure 1I:
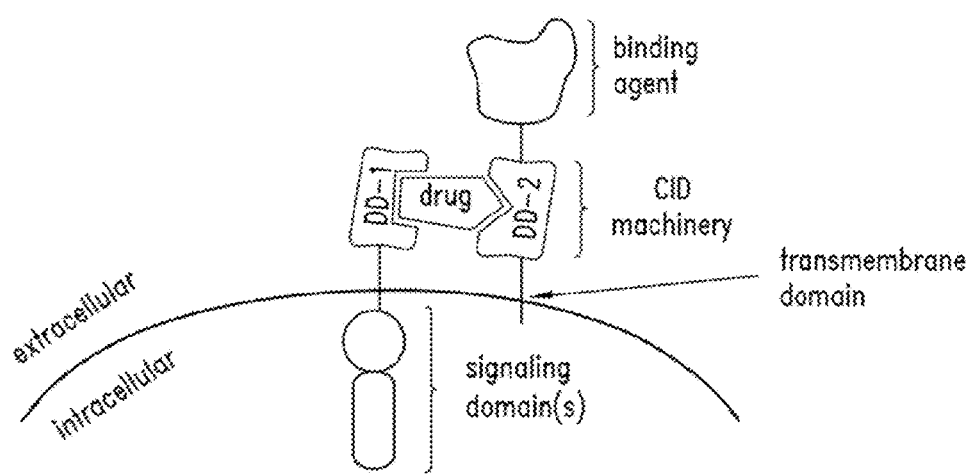
Figure 1J:
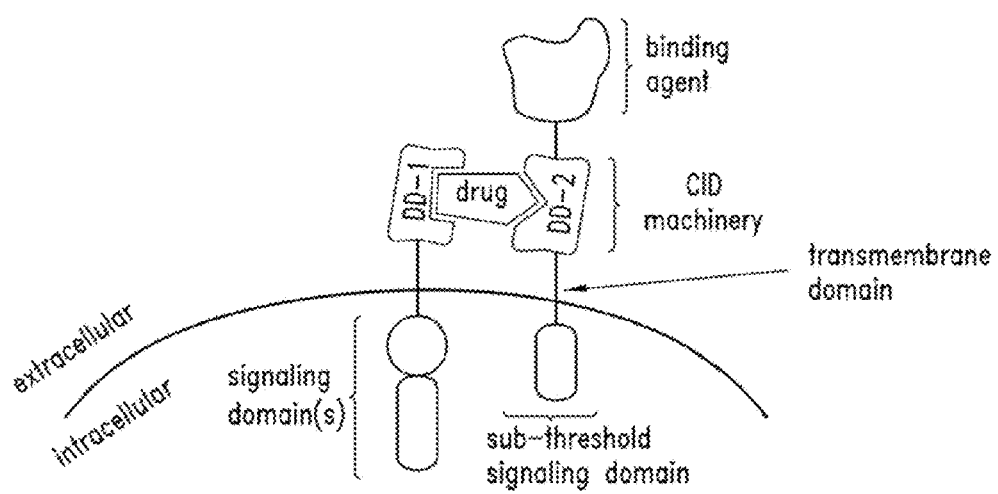
Figure 1K:
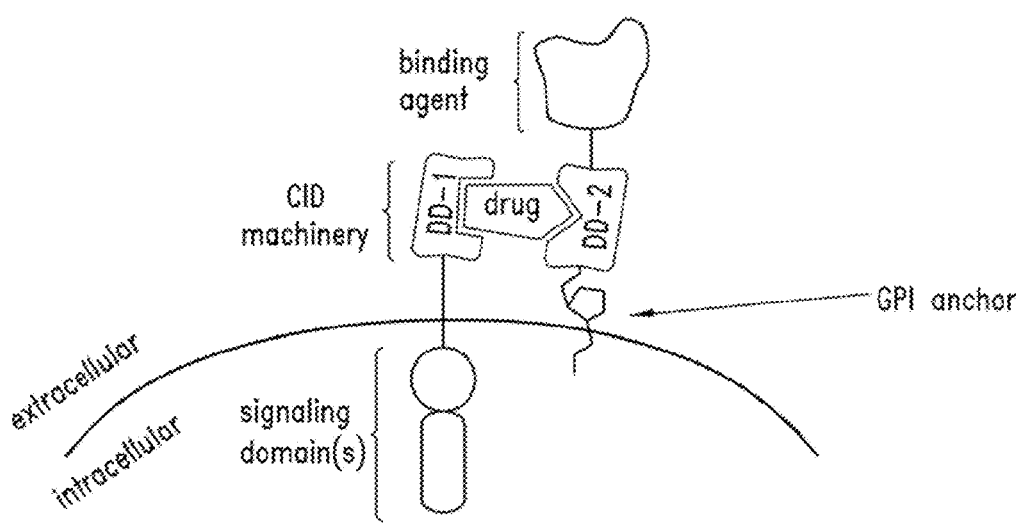
Figure 1L:
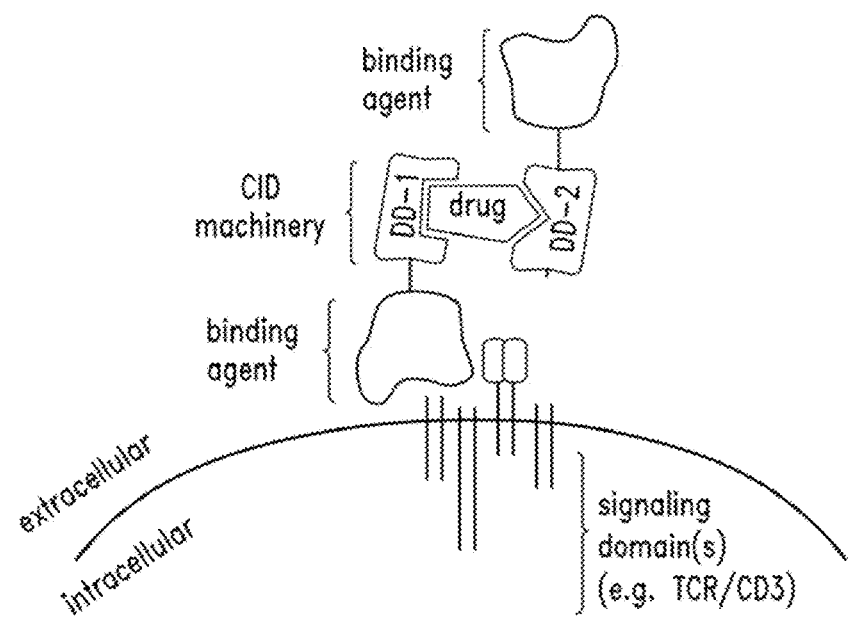
Figure 1M:
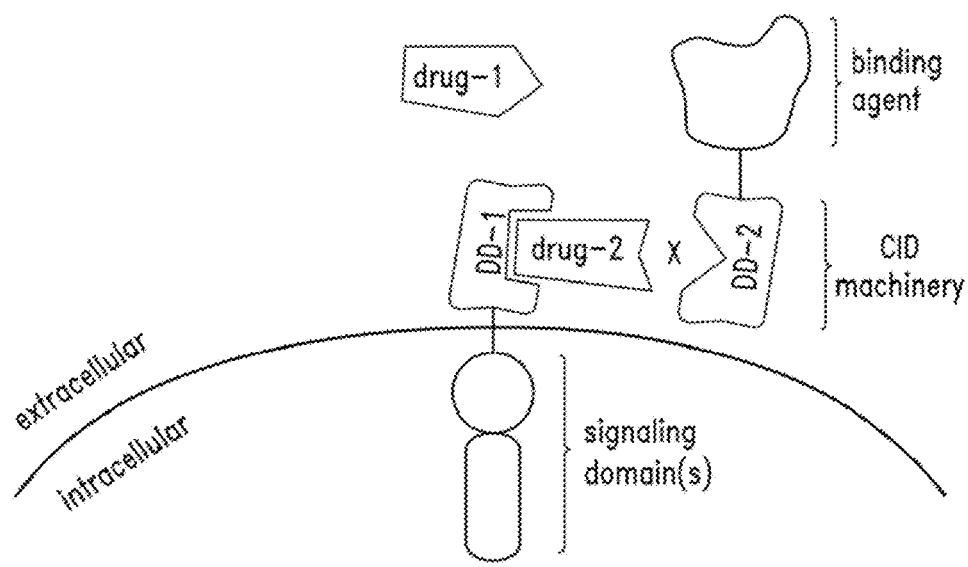
Figure 2:
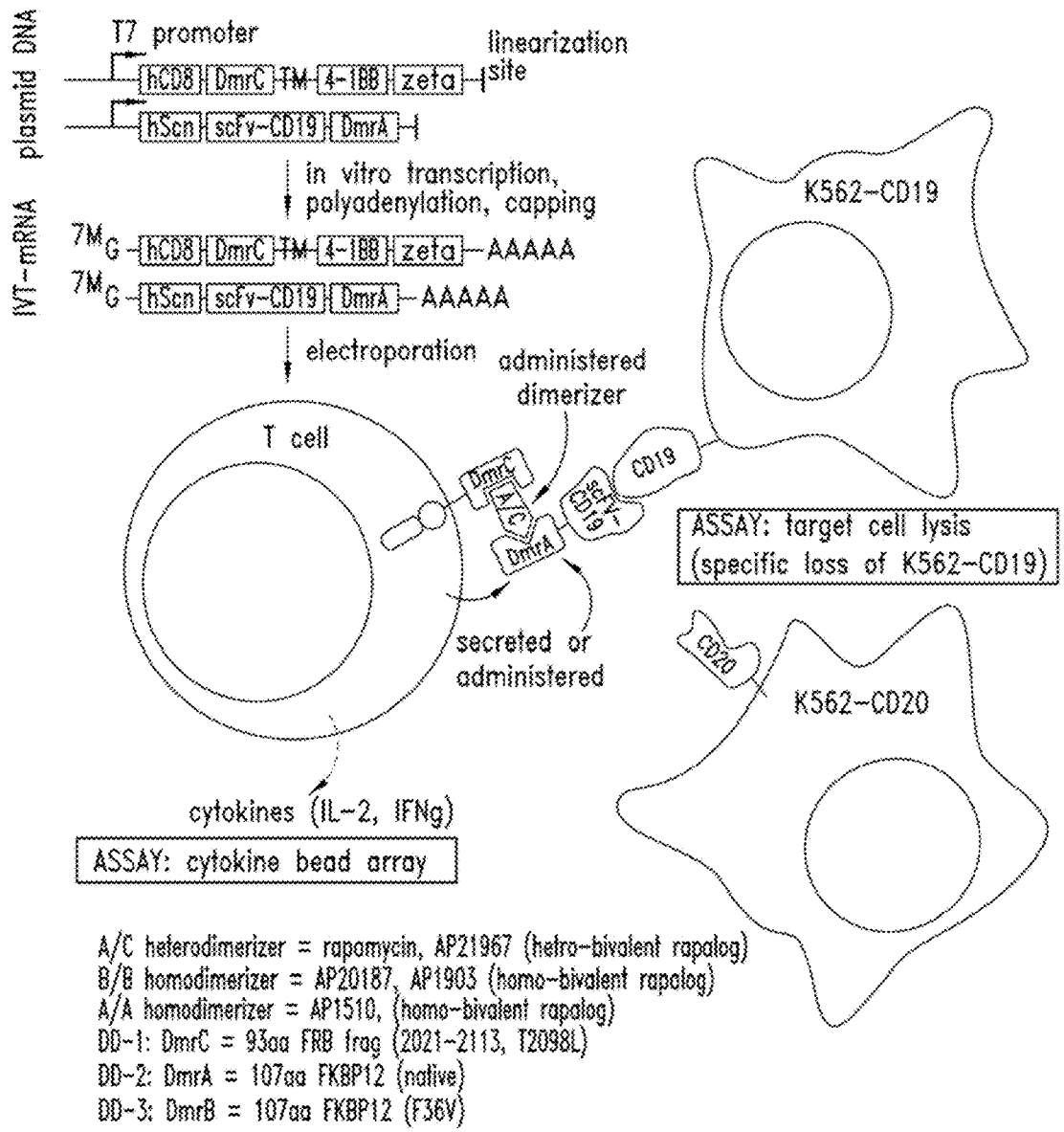
FIG. 2 shows a schematic of an assay to detect specific cell killing and cytokine secretion with a particular multipartite signaling complex of this disclosure.

A series of additional DARIC molecules, in which the antigen binding component was maintained on the T cell surface rather than released into the extracellular space, were tested (see, e.g., FIG. 1I). Several protein regions and transmembrane domains were used to anchor the binding domain to the T cell surface (SEQ ID NOS.:50, 53, 56, 59), each altering the spacing or steric parameters governing multimerization of the DARIC binding and signaling components. As in the previous examples, antigen-specific cytotoxicity responses using lentivirus-transduced T cells and 50:50 mixtures of the K562-CD19 and K562-CD20 target cells were used to evaluate the tethered DARIC binding component. The overall ratio of T cells to K562 cells was 5:1 in all samples, with the indicated concentrations of a bridging factor used in experimental samples.

Each design had the property of bridging factor-responsive, antigen-specific cytotoxicity against the K562-CD19 cells. The tethered DARIC binding component containing the CD8 hinge/CD8 transmembrane domain (SEQ ID NO.: 53) showed a measurable level of activity in the absence of a bridging factor. The tethered DARIC binding component comprising the IgG4 CH2CH3 spacer with CD4 transmembrane domain (SEQ ID NO.:56) provided the strongest cytotoxic response upon addition of the rapamycin (bridging factor), while the tethered DARIC binding component comprising only the CD4 transmembrane domain (SEQ ID NO.:50) were moderately active (FIG. 7). A DARIC binding components comprising a GPI signal sequence from the CD52 protein (see schematic in FIG. 1K) were also tested. The GPI anchored DARIC produced an antigen specific cytotoxicity response only in the presence of an appropriate bridging factor (FIG. 8). These data demonstrate that a DARIC binding component can be either released or tethered to the cell surface and still function with a DARIC signaling component.

Additional lentiviral constructs comprising tethered DARIC binding components were generated and similarly tested in human T cells, including a modified CD4 transmembrane domain with improved activity over other transmembrane tethered DARIC binding components (SEQ ID NOs.:64-69). Additionally, the DARIC signaling and binding components were integrated into a single open reading frame comprising a 2A peptide situated between the two components (such as that used in FIG. 11), thus validating a simplified DARIC delivery scheme using a single lentiviral vector (SEQ ID NOs.:66, 69, 72).

For any of the DARIC componentry designs, similar results are expected using a variety of lentiviral vector designs, such as those comprising bi-directional promoters (SEQ ID NO.:73) for example, or using alternative transgene delivery vectors (e.g., adenovirus or AAV) and schemes such as including the targeted integration of transgenes via homologous recombination, a process that can be stimulated to high efficiency using gene-specific nucleases.

Example 7

DARIC Targeting of Additional Model Antigens

The DARIC system was extended to an additional model antigen to show the broad applicability of artificial cells expressing drug regulated multipartite receptors contemplated herein. K562 target cell lines were generated to express the CD123 antigen by sub-cloning this antigen into a lentiviral vector comprising a puromycin selection cassette (SEQ ID NO.:74), lentiviral particles were produced, and K562 cells were infected and selected with puromycin. Primary human T cells were isolated, activated, and then transduced with lentiviral vectors encoding a CD123 targeting DARIC binding component along with the DARIC signaling component (SEQ ID NOs.:70-72). Antigen-specific cytotoxicity responses were evaluated using lentivirus-transduced T cells co-cultured with 50:50 mixtures of the K562-CD19 and K562-CD123 target cells, using a traditional CD123 targeting chimeric antigen receptor (CAR) as a positive control. The overall ratio of T cells to K562 cells was 5:1 in all samples, with the indicated concentrations of a bridging factor used in experimental samples. Cytotoxicity was observed in the positive control sample and in the CD123 DARIC sample containing rapamycin. The results demonstrated that bridging factor dependent cytotoxic activity could be achieved with the DARIC system targeting diverse antigens (FIG. 9).

Example 8

Deactivation of DARIC Using an Anti-Bridging Factor

Deactivation of the DARIC system by the addition of a pharmacological agent that competes for binding to one of the multimerization domains was tested. Primary human T cells expressing either a traditional CD19 targeting CAR or primary human T cells expressing the CD19 targeting DARIC components (SEQ ID NO.:66) were co-incubated with 50:50 mixtures of K562-CD19 and K562-CD20 cells. For the T cells expressing the CD19 targeting CAR (SEQ ID NO.:14), cytotoxicity was observed both in the presence or absence of rapamycin. In contrast, CD19 targeting DARIC T cells, showed efficient antigen-specific cytotoxicity in the presence of sub-nanomolar levels of rapamycin, but showed no cytotoxicity in the absence of the bridging factor (FIG. 11). However, when FK506 was added, a marked reduction in antigen specific cytotoxicity was observed for the DARIC T cells while a minimal reduction was observed for the CAR T cells, indicating that FK506 disrupted the coupling of the DARIC componentry and deactivated the antigen-driven cytotoxicity response.

This example shows that a competitive inhibitor of a bridging factor substantially inhibited DARIC antigen receptors and therefore is suitable for clinical use to limit pathology that can arise as a result of excessive proliferation or activation of administered cells. Without wishing to be bound to any particular theory, this strategy may be particularly effective if the inhibitor has additional immunosuppressive mechanisms of action involving native proteins that contribute in cellular responses, as is true of FK506 inhibiting intracellular cyclophilins that promote T cell proliferative responses.

Example 9

DARIC System Leveraging an Endogenous Signaling Receptor

A DARIC system was designed to provide two secreted DARIC components (SEQ ID NO.:75). The DARIC binding component comprises a binding domain that binds CD19 and the DARIC signaling component comprises a binding domain that binds CD3 and a multimerization domain. This system will be tested using a modified co-culture cytotoxicity experiment. Supernatants from T cells transduced with lentiviral particles encoding the two secreted DARIC components will be transferred to a 50:50 mix of K562-CD19 and K562-CD20 target cells also containing non-transduced T cells. Cytotoxicity will be measured in the presence and absence of bridging factor. Control samples comprising the supernatant that is kept in a decoupled state by not providing the bridging factor are not expected to show any antigen specific cytotoxicity. However, samples in which the supernatant and bridging factor are added are expected to initiate the antigen specific cytotoxicity response. This result will demonstrate that artificial cells can be made to express a soluble DARIC system that can systemically initiate cytotoxicity responses in a drug regulated fashion.

Example 10

Bicistronic DARIC Vectors

Primary human T cells were isolated, activated, and then transduced with lentiviral vectors encoding bicistronic DARIC vectors (SEQ ID NOS.: 73 and 76) or polycistronic vectors that encode both anti-CD19 DARIC binding and DARIC signaling components. The transduced T cells were then co-incubated with about a 50:50 mixture of the K562 target cells expressing CD19 (K562-CD19) or a human leukemic B cell line expressing CD19 (Nalm6-DSMZ no.: ACC 128).

Antigen specific cytotoxicity was observed in the presence of the bridging factor rapamycin (10 nM) in both bicistronic and polycistronic DARIC vectors as shown in FIG. 12.

Example 11

Secreted DARIC Signaling Components Show Antigen Specific Cytotoxicity

Primary human T cells were isolated, activated, and then transduced with lentiviral vectors encoding DARIC signaling components (SEQ ID NOS.: 79 and 80) and HEK293T cells were transduced with vectors encoding DARIC binding components (SEQ ID NOS.: 82 and 84). The transduced HEK293T cells secreted the DARIC binding component into the culture medium (see, e.g., FIG. 13A).

The transduced T cells were then co-incubated with K562 target cells expressing either CD19 (K562-CD19) or CD20 (K562-CD20) in the presence of a secreted DARIC binding component that targets either CD19 or CD20 to evaluate antigen-specific cytotoxicity. In control samples, untransduced T cells were used.

In the presence of the bridging factor rapamycin (1 nM), cultures containing a secreted anti-CD19 DARIC binding component and a DARIC signaling component show cytotoxicity at all T cell:K562-CD19 cell ratios tested (8:1, 4:1, and 2:1) (see, e.g., FIG. 13B). In the presence of the bridging factor rapamycin (1 nM), cultures containing a secreted anti-CD20 DARIC binding component and a DARIC signaling component show cytotoxicity at the only T cell:K562-CD20 cell ratio tested (10:1) (see, e.g., FIG. 13C). Little or no cytotoxicity was observed in the untransduced T cell controls, which do not express DARIC signaling components.

Example 12

Use of Tethered DARIC Binding Components with Improved Basal Cytotoxicity Characteristics Primary human T cells were isolated, activated, and then transduced with lentiviral vectors encoding (i) an anti-CD19 single-chain chimeric antigen receptor (CAR) (CD19-CAR, SEQ ID NO.:14; (ii) a transmembrane DARIC that targets CD19 expressing cells and that has residual cytotoxic activity independent of bridging factor (SEQ ID NO: 64); (iii) a soluble DARIC that targets CD19 expressing cells (SEQ ID NOs: 99-100); and (iv) a transmembrane DARIC that targets CD19 expressing cells and that lacks residual cytotoxic activity in the absence of bridging factor (SEQ ID NO: 77).

Transduced T cells were co-incubated with K562-CD19 target cells or a human B cell line expressing CD19 at ratios of 8:1, 4:1, and 2:1. Antigen specific cytotoxicity was measured in the presence and absence of the bridging factor rapamycin (1 nM). T cells that expressed the soluble DARIC and T cells that expressed the CD154 transmembrane DARIC showed low to absent cytotoxicity in the absence of the bridging factor rapamycin compared to the CD19 CAR or a CD4 transmembrane DARIC, and T cells that expressed any of the CAR or DARIC constructs delivered potent cytotoxic effects in the presence of rapamycin. FIGS. 14A and B.

Example 13

Second Generation DARIC Constructs Show Improved Antigen Specific Cytotoxicity Profiles Primary human T cells were isolated, activated, and then transduced with lentiviral vectors encoding second generation DARIC constructs comprising (A) CD19 DARIC binding components that contain a CD154 transmembrane domain or (B) CD19 DARIC binding components comprising that contain a CD71 transmembrane domain.

Four groups of T cells were transduced with one or more vectors encoding a CD19 DARIC binding component that contains a CD154 transmembrane domain and: (i) a DARIC signaling component comprising a DmrC multimerization domain and a CD8 transmembrane domain (SEQ ID NO: 77); (ii) a DARIC signaling component comprising an FRB multimerization domain and a CD8 transmembrane domain (SEQ ID NO: 87); a DARIC signaling component comprising an FRB multimerization domain, a CD8 hinge domain, and a CD8 transmembrane domain (SEQ ID NO: 89); or a DARIC signaling component comprising a FRB multimerization domain and an AMN transmembrane domain (SEQ ID NO: 91). Transduced T cells were co-incubated with CD19 expressing Daudi cells at ratios of 8:1, 4:1, 2:1, 1:1, and 0.5:1. T cells that expressed CD154 transmembrane DARICs exhibited low to absent cytotoxicity in the absence of the bridging factor rapamycin compared to untransduced T cells and delivered potent cytotoxic effects in the presence of rapamycin. FIG. 15A.

Two groups of T cells transduced with one or more vectors encoding (i) a first generation transmembrane DARIC that targets CD19 expressing cells and that has residual cytotoxic activity independent of bridging factor (SEQ ID NO: 64); (ii) a CD19 DARIC binding component that contains a CD71 type I transmembrane domain and a DARIC signaling component comprising a DmrC multimerization domain and a CD8 transmembrane domain (SEQ ID NO: 95); or (iii) a CD19 DARIC binding component that contains a CD71 type II transmembrane domain and a DARIC signaling component comprising a DmrC multimerization domain and a CD8 transmembrane domain (SEQ ID NO: 97). Transduced T cells were co-incubated with CD19 expressing Nalm6 cells at ratios of 8:1, 4:1, 2:1, 1:1, and 0.5:1. T cells that expressed the CD71 transmembrane DARICs exhibited low to absent cytotoxicity in the absence of the bridging factor rapamycin compared to untransduced T cells and delivered potent cytotoxic effects in the presence of rapamycin. FIG. 15B.

The various embodiments described above can be combined to provide further embodiments. All of the U.S. patents, U.S. patent application publications, U.S. patent applications, foreign patents, foreign patent applications and non-patent publications referred to in this specification and/or listed in the Application Data Sheet are incorporated herein by reference, in their entirety. Aspects of the embodiments can be modified, if necessary to employ concepts of the various patents, applications and publications to provide yet further embodiments.

These and other changes can be made to the embodiments in light of the above-detailed description. In general, in the following claims, the terms used should not be construed to limit the claims to the specific embodiments disclosed in the specification and the claims, but should be construed to include all possible embodiments along with the full scope of equivalents to which such claims are entitled. Accordingly, the claims are not limited by the disclosure.

SEQUENCE LISTING (100 sequences)

SEQ ID NO: 1 - protein, 363 aa, Artificial Sequence
  scFvCD19-DmrA protein
MGSDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSASGGGGSGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLEG

SEQ ID NO: 2 - RNA, 1149 nt, Artificial Sequence
  SS-scFvCD19-DmrA mRNA
augccccugggccugcuguggcugggccuggcccugcugggcgcccugcacgcccaggccggauccgauauccagaugacccagaccaccagcagccugagcgccagccugggcgauagagugaccaucagcugcagagccagccaggacaucagcaaguaccugaacugguaucagcagaaacccgacggcaccgugaagcugcugaucuaccacaccagcagacugcacagcggcgugcccagcagauuuucuggcagcggcuccggcaccgacuacagccugaccaucuccaaccuggaacaggaagauaucgcuaccuacuucugucagcaaggcaacacccugcccuacaccuucggcggaggcaccaagcuggaaaucaccggcagcacaagcggcagcggcaagccuggaucuggcgagggaagcaccaagggcgaagugaaacugcaggaaagcggcccuggacugguggccccaagccagucucugagcgugaccuguaccguguccggcgugucccugccugacuauggcguguccuggaucagacagccccccagaaagggccuggaauggcugggagugaucuggggcagcgagacaaccuacuacaacagcgcccugaagucccggcugaccaucaucaaggacaacuccaagagccagguguuccugaagaugaacagccugcagaccgacgacaccgccaucuacuacugcgccaagcacuacuacuacggcggcagcuacgccauggacuacuggggccagggcacaagcgugaccguguccagcgcuagcggcggaggugggagcggagugcagguggaaaccaucuccccaggagacgggcgcaccuuccccaagcgcggccagaccugcguggugcacuacaccgggaugcuugaagauggaaagaaauuugauuccucccgggacagaaacaagcccuuuaaguuuaugcuaggcaagcaggaggugauccgaggcugggaagaagggguugcccagaugagugugggucagagagccaaacugacuauaucuccagauuaugccuauggugccacugggcacccaggcaucaucccaccacaugccacucucgucuucgauguggagcuucuaaaacuggaaggcuga

SEQ ID NO: 3 - DNA, 1149 bp, Artificial Sequence
  SS-scFvCD19-DmrA DNA
atgcccctgggcctgctgtggctgggcctggccctgctgggcgccctgcacgcccaggccggatccgatatccagatgacccagaccaccagcagcctgagcgccagcctgggcgatagagtgaccatcagctgcagagccagccaggacatcagcaagtacctgaactggtatcagcagaaacccgacggcaccgtgaagctgctgatctaccacaccagcagactgcacagcggcgtgcccagcagattttctggcagcggctccggcaccgactacagcctgaccatctccaacctggaacaggaagatatcgctacctacttctgtcagcaaggcaacaccctgccctacaccttcggcggaggcaccaagctggaaatcaccggcagcacaagcggcagcggcaagcctggatctggcgagggaagcaccaagggcgaagtgaaactgcaggaaagcggccctggactggtggccccaagccagtctctgagcgtgacctgtaccgtgtccggcgtgtccctgcctgactatggcgtgtcctggatcagacagccccccagaaagggcctggaatggctgggagtgatctggggcagcgagacaacctactacaacagcgccctgaagtcccggctgaccatcatcaaggacaactccaagagccaggtgttcctgaagatgaacagcctgcagaccgacgacaccgccatctactactgcgccaagcactactactacggcggcagctacgccatggactactggggccagggcacaagcgtgaccgtgtccagcgctagcggcggaggtgggagcggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaaggctga

SEQ ID NO: 4 - protein, 363 aa, Artificial Sequence
  scFvCD19-DmrB protein
MGSDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSASGGGGSGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEG

SEQ ID NO: 5 - RNA, 1149 nt, Artificial Sequence
  SS-scFvCD19-DmrB mRNA
augccccugggccugcuguggcugggccuggcccugcugggcgcccugcacgcccaggccggauccgauauccagaugacccagaccaccagcagccugagcgccagccugggcgauagagugaccaucagcugcagagccagccaggacaucagcaaguaccugaacugguaucagcagaaacccgacggcaccgugaagcugcugaucuaccacaccagcagacugcacagcggcgugcccagcagauuuucuggcagcggcuccggcaccgacuacagccugaccaucuccaaccuggaacaggaagauaucgcuaccuacuucugucagcaaggcaacacccugcccuacaccuucggcggaggcaccaagcuggaaaucaccggcagcacaagcggcagcggcaagccuggaucuggcgagggaagcaccaagggcgaagugaaacugcaggaaagcggcccuggacugguggccccaagccagucucugagcgugaccuguaccguguccggcgugucccugccugacuauggcguguccuggaucagacagccccccagaaagggccuggaauggcugggagugaucuggggcagcgagacaaccuacuacaacagcgcccugaagucccggcugaccaucaucaaggacaacuccaagagccagguguuccugaagaugaacagccugcagaccgacgacaccgccaucuacuacugcgccaagcacuacuacuacggcggcagcuacgccauggacuacuggggccagggcacaagcgugaccguguccagcgcuagcggcggaggugggagcggagugcagguggaaaccaucuccccaggagacgggcgcaccuuccccaagcgcggccagaccugcguggugcacuacaccgggaugcuugaagauggaaagaaaguugauuccucccgggacagaaacaagcccuuuaaguuuaugcuaggcaagcaggaggugauccgaggcugggaagaagggguugcccagaugagugugggucagagagccaaacugacuauaucuccagauuaugccuauggugccacugggcacccaggcaucaucccaccacaugccacucucgucuucgauguggagcuucuaaaacuggaaggcuga

SEQ ID NO: 6 - DNA, 1149 bp, Artificial Sequence
  SS-scFvCD19-DmrB DNA
atgcccctgggcctgctgtggctgggcctggccctgctgggcgccctgcacgcccaggccggatccgatatccagatgacccagaccaccagcagcctgagcgccagcctgggcgatagagtgaccatcagctgcagagccagccaggacatcagcaagtacctgaactggtatcagcagaaacccgacggcaccgtgaagctgctgatctaccacaccagcagactgcacagcggcgtgcccagcagattttctggcagcggctccggcaccgactacagcctgaccatctccaacctggaacaggaagatatcgctacctacttctgtcagcaaggcaacaccctgccctacaccttcggcggaggcaccaagctggaaatcaccggcagcacaagcggcagcggcaagcctggatctggcgagggaagcaccaagggcgaagtgaaactgcaggaaagcggccctggactggtggccccaagccagtctctgagcgtgacctgtaccgtgtccggcgtgtccctgcctgactatggcgtgtcctggatcagacagccccccagaaagggcctggaatggctgggagtgatctggggcagcgagacaacctactacaacagcgccctgaagtcccggctgaccatcatcaaggacaactccaagagccaggtgttcctgaagatgaacagcctgcagaccgacgacaccgccatctactactgcgccaagcactactactacggcggcagctacgccatggactactggggccagggcacaagcgtgaccgtgtccagcgctagcggcggaggtgggagcggagtgcaggtggaaaccatctccccaggagacgggcgcaccttccccaagcgcggccagacctgcgtggtgcactacaccgggatgcttgaagatggaaagaaagttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaaggctga

SEQ ID NO: 7 - protein, 349 aa, Artificial Sequence
  scFvCD19-DmrC protein
MGSDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSASGGGGSILWHEMWHEGLEEASRLYFGERNVKGMFEVLEPLHAMMERGPQTLKETSFNQAYGRDLMEAQEWCRKYMKSGNVKDLLQAWDLYYHVFRRISKG

SEQ ID NO: 8 - RNA, 1107 nt, Artificial Sequence
  SS-scFvCD19-DmrC mRNA
augccccugggccugcuguggcugggccuggcccugcugggcgcccugcacgcccaggccggauccgauauccagaugacccagaccaccagcagccugagcgccagccugggcgauagagugaccaucagcugcagagccagccaggacaucagcaaguaccugaacugguaucagcagaaacccgacggcaccgugaagcugcugaucuaccacaccagcagacugcacagcggcgugcccagcagauuuucuggcagcggcuccggcaccgacuacagccugaccaucuccaaccuggaacaggaagauaucgcuaccuacuucugucagcaaggcaacacccugcccuacaccuucggcggaggcaccaagcuggaaaucaccggcagcacaagcggcagcggcaagccuggaucuggcgagggaagcaccaagggcgaagugaaacugcaggaaagcggcccuggacugguggccccaagccagucucugagcgugaccuguaccguguccggcgugucccugccugacuauggcguguccuggaucagacagccccccagaaagggccuggaauggcugggagugaucuggggcagcgagacaaccuacuacaacagcgcccugaagucccggcugaccaucaucaaggacaacuccaagagccagguguuccugaagaugaacagccugcagaccgacgacaccgccaucuacuacugcgccaagcacuacuacuacggcggcagcuacgccauggacuacuggggccagggcacaagcgugaccguguccagcgcuagcggcggaggugggagcauccucuggcaugagauguggcaugaaggccuggaagaggcaucucguuuguacuuuggggaaaggaacgugaaaggcauguuugaggugcuggagcccuugcaugcuaugauggaacggggcccccagacucugaaggaaacauccuuuaaucaggccuauggucgagauuuaauggaggcccaagaguggugcaggaaguacaugaaaucagggaaugucaaggaccuccuccaagccugggaccucuauuaucauguguuccgacgaaucucaaagggcuga

SEQ ID NO: 9 - DNA, 1107 bp, Artificial Sequence
  SS-scFvCD19-DmrC DNA
atgcccctgggcctgctgtggctgggcctggccctgctgggcgccctgcacgcccaggccggatccgatatccagatgacccagaccaccagcagcctgagcgccagcctgggcgatagagtgaccatcagctgcagagccagccaggacatcagcaagtacctgaactggtatcagcagaaacccgacggcaccgtgaagctgctgatctaccacaccagcagactgcacagcggcgtgcccagcagattttctggcagcggctccggcaccgactacagcctgaccatctccaacctggaacaggaagatatcgctacctacttctgtcagcaaggcaacaccctgccctacaccttcggcggaggcaccaagctggaaatcaccggcagcacaagcggcagcggcaagcctggatctggcgagggaagcaccaagggcgaagtgaaactgcaggaaagcggccctggactggtggccccaagccagtctctgagcgtgacctgtaccgtgtccggcgtgtccctgcctgactatggcgtgtcctggatcagacagccccccagaaagggcctggaatggctgggagtgatctggggcagcgagacaacctactacaacagcgccctgaagtcccggctgaccatcatcaaggacaactccaagagccaggtgttcctgaagatgaacagcctgcagaccgacgacaccgccatctactactgcgccaagcactactactacggcggcagctacgccatggactactggggccagggcacaagcgtgaccgtgtccagcgctagcggcggaggtgggagcatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcctccaagcctgggacctctattatcatgtgttccgacgaatctcaaagggctga

SEQ ID NO: 10 - DNA, 7255 bp, Artificial Sequence
  pCVL_T7_scFvCD19-DmrA-BFP lentiviral vector
aaaaataaacaaataggggttccgcgcacatttccccgaaaagtgccacctgacgtcaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaatgaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcggttaacttttaaaagaaaaggggggattggggggtacagtgcaggggaaagaatagtagacataatagcaacagacatacaaactaaagaattacaaaaacaaattacaaaaattcaaaattttatcgattacgcgtaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacacctgcaggtaatacgactcactatagggtccactgccgccaccatgcccctgggcctgctgtggctgggcctggccctgctgggcgccctgcacgcccaggccggatccgatatccagatgacccagaccaccagcagcctgagcgccagcctgggcgatagagtgaccatcagctgcagagccagccaggacatcagcaagtacctgaactggtatcagcagaaacccgacggcaccgtgaagctgctgatctaccacaccagcagactgcacagcggcgtgcccagcagattttctggcagcggctccggcaccgactacagcctgaccatctccaacctggaacaggaagatatcgctacctacttctgtcagcaaggcaacaccctgccctacaccttcggcggaggcaccaagctggaaatcaccggcagcacaagcggcagcggcaagcctggatctggcgagggaagcaccaagggcgaagtgaaactgcaggaaagcggccctggactggtggccccaagccagtctctgagcgtgacctgtaccgtgtccggcgtgtccctgcctgactatggcgtgtcctggatcagacagccccccagaaagggcctggaatggctgggagtgatctggggcagcgagacaacctactacaacagcgccctgaagtcccggctgaccatcatcaaggacaactccaagagccaggtgttcctgaagatgaacagcctgcagaccgacgacaccgccatctactactgcgccaagcactactactacggcggcagctacgccatggactactggggccagggcacaagcgtgaccgtgtccagcgctagcggcggaggtgggagcggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaaggcggccgctccggtgagggcagaggaagtcttctaacatgcggtgacgtggaggagaatccgggcccctctagaagcgagctgattaaggagaacatgcacatgaagctgtacatggagggcaccgtggacaaccatcacttcaagtgcacatccgagggcgaaggcaagccctacgagggcacccagaccatgagaatcaaggtggtcgagggcggccctctccccttcgccttcgacatcctggctactagcttcctctacggcagcaagaccttcatcaaccacacccagggcatccccgacttcttcaagcagtccttccctgagggcttcacatgggagagagtcaccacatacgaagacgggggcgtgctgaccgctacccaggacaccagcctccaggacggctgcctcatctacaacgtcaagatcagaggggtgaacttcacatccaacggccctgtgatgcagaagaaaacactcggctgggaggccttcaccgagacgctgtaccccgctgacggcggcctggaaggcagaaacgacatggccctgaagctcgtgggcgggagccatctgatcgcaaacatcaagaccacatatagatccaagaaacccgctaagaacctcaagatgcctggcgtctactatgtggactacagactggaaagaatcaaggaggccaacaacgagacctacgtcgagcagcacgaggtggcagtggccagatactgcgacctccctagcaaactggggcacaagcttaattgagtcgaccgagcatcttaccgccatttatacccatatttgttctgtttttcttgatttgggtatacatttaaatgttaatagaacaaaatggtggggcaatcatttacatttttagggatatgtaattactagttcaggtgtattgccacaagacaaacatgttaagaaactttcccgttatttacgctctgttcctgttaatcaacctctggattacaaaatttgtgaaagattgactgatattcttaactatgttgctccttttacgctgtgtggatatgctgctttatagcctctgtatctagctattgcttcccgtacggctttcgttttctcctccttgtataaatcctggttgctgtctcttttagaggagttgtggcccgttgtccgtcaacgtggcgtggtgtgctctgtgtttgctgacgcaacccccactggctggggcattgccaccacctgtcaactcctttctgggactttcgctttccccctcccgatcgccacggcagaactcatcgccgcctgccttgcccgctgctggacaggggctaggttgctgggcactgataattccgtggtgttgtcatcgaattcggtacctttttaaaagaaaaggggggactggaagggctaattcactcccaacgaagacaagatatcataacttcgtatagcatacattatacgaagttataatttatttgtgaaatttgtgatgctattgctttatttgtaaccatatgtttatttgtgaaatttgtgatgctattgctttatttgtaaccattgctttttgcttgtactgggtctctctggttagaccagatctgagcctgggagctctctggctaactagggaacccactgcttaagcctcaataaagcttgcctcgaccagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcctgcagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttag

SEQ ID NO: 11 - DNA, 7255 bp, Artificial Sequence
  pCVL_T7_scFvCD19-DmrB-BFP lentiviral vector
aaaaataaacaaataggggttccgcgcacatttccccgaaaagtgccacctgacgtcaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaatgaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcggttaacttttaaaagaaaaggggggattggggggtacagtgcaggggaaagaatagtagacataatagcaacagacatacaaactaaagaattacaaaaacaaattacaaaaattcaaaattttatcgattacgcgtaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacacctgcaggtaatacgactcactatagggtccactgccgccaccatgcccctgggcctgctgtggctgggcctggccctgctgggcgccctgcacgcccaggccggatccgatatccagatgacccagaccaccagcagcctgagcgccagcctgggcgatagagtgaccatcagctgcagagccagccaggacatcagcaagtacctgaactggtatcagcagaaacccgacggcaccgtgaagctgctgatctaccacaccagcagactgcacagcggcgtgcccagcagattttctggcagcggctccggcaccgactacagcctgaccatctccaacctggaacaggaagatatcgctacctacttctgtcagcaaggcaacaccctgccctacaccttcggcggaggcaccaagctggaaatcaccggcagcacaagcggcagcggcaagcctggatctggcgagggaagcaccaagggcgaagtgaaactgcaggaaagcggccctggactggtggccccaagccagtctctgagcgtgacctgtaccgtgtccggcgtgtccctgcctgactatggcgtgtcctggatcagacagccccccagaaagggcctggaatggctgggagtgatctggggcagcgagacaacctactacaacagcgccctgaagtcccggctgaccatcatcaaggacaactccaagagccaggtgttcctgaagatgaacagcctgcagaccgacgacaccgccatctactactgcgccaagcactactactacggcggcagctacgccatggactactggggccagggcacaagcgtgaccgtgtccagcgctagcggcggaggtgggagcggagtgcaggtggaaaccatctccccaggagacgggcgcaccttccccaagcgcggccagacctgcgtggtgcactacaccgggatgcttgaagatggaaagaaagttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaaggcggccgctccggtgagggcagaggaagtcttctaacatgcggtgacgtggaggagaatccgggcccctctagaagcgagctgattaaggagaacatgcacatgaagctgtacatggagggcaccgtggacaaccatcacttcaagtgcacatccgagggcgaaggcaagccctacgagggcacccagaccatgagaatcaaggtggtcgagggcggccctctccccttcgccttcgacatcctggctactagcttcctctacggcagcaagaccttcatcaaccacacccagggcatccccgacttcttcaagcagtccttccctgagggcttcacatgggagagagtcaccacatacgaagacgggggcgtgctgaccgctacccaggacaccagcctccaggacggctgcctcatctacaacgtcaagatcagaggggtgaacttcacatccaacggccctgtgatgcagaagaaaacactcggctgggaggccttcaccgagacgctgtaccccgctgacggcggcctggaaggcagaaacgacatggccctgaagctcgtgggcgggagccatctgatcgcaaacatcaagaccacatatagatccaagaaacccgctaagaacctcaagatgcctggcgtctactatgtggactacagactggaaagaatcaaggaggccaacaacgagacctacgtcgagcagcacgaggtggcagtggccagatactgcgacctccctagcaaactggggcacaagcttaattgagtcgaccgagcatcttaccgccatttatacccatatttgttctgtttttcttgatttgggtatacatttaaatgttaatagaacaaaatggtggggcaatcatttacatttttagggatatgtaattactagttcaggtgtattgccacaagacaaacatgttaagaaactttcccgttatttacgctctgttcctgttaatcaacctctggattacaaaatttgtgaaagattgactgatattcttaactatgttgctccttttacgctgtgtggatatgctgctttatagcctctgtatctagctattgcttcccgtacggctttcgttttctcctccttgtataaatcctggttgctgtctcttttagaggagttgtggcccgttgtccgtcaacgtggcgtggtgtgctctgtgtttgctgacgcaacccccactggctggggcattgccaccacctgtcaactcctttctgggactttcgctttccccctcccgatcgccacggcagaactcatcgccgcctgccttgcccgctgctggacaggggctaggttgctgggcactgataattccgtggtgttgtcatcgaattcggtacctttttaaaagaaaaggggggactggaagggctaattcactcccaacgaagacaagatatcataacttcgtatagcatacattatacgaagttataatttatttgtgaaatttgtgatgctattgctttatttgtaaccatatgtttatttgtgaaatttgtgatgctattgctttatttgtaaccattgctttttgcttgtactgggtctctctggttagaccagatctgagcctgggagctctctggctaactagggaacccactgcttaagcctcaataaagcttgcctcgaccagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcctgcagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttag

SEQ ID NO: 12 - DNA, 7213 bp, Artificial Sequence
  pCVL_T7_scFvCD19-DmrC-BFP lentiviral vector
aaaaataaacaaataggggttccgcgcacatttccccgaaaagtgccacctgacgtcaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaatgaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcggttaacttttaaaagaaaaggggggattggggggtacagtgcaggggaaagaatagtagacataatagcaacagacatacaaactaaagaattacaaaaacaaattacaaaaattcaaaattttatcgattacgcgtaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacacctgcaggtaatacgactcactatagggtccactgccgccaccatgcccctgggcctgctgtggctgggcctggccctgctgggcgccctgcacgcccaggccggatccgatatccagatgacccagaccaccagcagcctgagcgccagcctgggcgatagagtgaccatcagctgcagagccagccaggacatcagcaagtacctgaactggtatcagcagaaacccgacggcaccgtgaagctgctgatctaccacaccagcagactgcacagcggcgtgcccagcagattttctggcagcggctccggcaccgactacagcctgaccatctccaacctggaacaggaagatatcgctacctacttctgtcagcaaggcaacaccctgccctacaccttcggcggaggcaccaagctggaaatcaccggcagcacaagcggcagcggcaagcctggatctggcgagggaagcaccaagggcgaagtgaaactgcaggaaagcggccctggactggtggccccaagccagtctctgagcgtgacctgtaccgtgtccggcgtgtccctgcctgactatggcgtgtcctggatcagacagccccccagaaagggcctggaatggctgggagtgatctggggcagcgagacaacctactacaacagcgccctgaagtcccggctgaccatcatcaaggacaactccaagagccaggtgttcctgaagatgaacagcctgcagaccgacgacaccgccatctactactgcgccaagcactactactacggcggcagctacgccatggactactggggccagggcacaagcgtgaccgtgtccagcgctagcggcggaggtgggagcatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcctccaagcctgggacctctattatcatgtgttccgacgaatctcaaagggcggccgctccggtgagggcagaggaagtcttctaacatgcggtgacgtggaggagaatccgggcccctctagaagcgagctgattaaggagaacatgcacatgaagctgtacatggagggcaccgtggacaaccatcacttcaagtgcacatccgagggcgaaggcaagccctacgagggcacccagaccatgagaatcaaggtggtcgagggcggccctctccccttcgccttcgacatcctggctactagcttcctctacggcagcaagaccttcatcaaccacacccagggcatccccgacttcttcaagcagtccttccctgagggcttcacatgggagagagtcaccacatacgaagacgggggcgtgctgaccgctacccaggacaccagcctccaggacggctgcctcatctacaacgtcaagatcagaggggtgaacttcacatccaacggccctgtgatgcagaagaaaacactcggctgggaggccttcaccgagacgctgtaccccgctgacggcggcctggaaggcagaaacgacatggccctgaagctcgtgggcgggagccatctgatcgcaaacatcaagaccacatatagatccaagaaacccgctaagaacctcaagatgcctggcgtctactatgtggactacagactggaaagaatcaaggaggccaacaacgagacctacgtcgagcagcacgaggtggcagtggccagatactgcgacctccctagcaaactggggcacaagcttaattgagtcgaccgagcatcttaccgccatttatacccatatttgttctgtttttcttgatttgggtatacatttaaatgttaatagaacaaaatggtggggcaatcatttacatttttagggatatgtaattactagttcaggtgtattgccacaagacaaacatgttaagaaactttcccgttatttacgctctgttcctgttaatcaacctctggattacaaaatttgtgaaagattgactgatattcttaactatgttgctccttttacgctgtgtggatatgctgctttatagcctctgtatctagctattgcttcccgtacggctttcgttttctcctccttgtataaatcctggttgctgtctcttttagaggagttgtggcccgttgtccgtcaacgtggcgtggtgtgctctgtgtttgctgacgcaacccccactggctggggcattgccaccacctgtcaactcctttctgggactttcgctttccccctcccgatcgccacggcagaactcatcgccgcctgccttgcccgctgctggacaggggctaggttgctgggcactgataattccgtggtgttgtcatcgaattcggtacctttttaaaagaaaaggggggactggaagggctaattcactcccaacgaagacaagatatcataacttcgtatagcatacattatacgaagttataatttatttgtgaaatttgtgatgctattgctttatttgtaaccatatgtttatttgtgaaatttgtgatgctattgctttatttgtaaccattgctttttgcttgtactgggtctctctggttagaccagatctgagcctgggagctctctggctaactagggaacccactgcttaagcctcaataaagcttgcctcgaccagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcctgcagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttag

SEQ ID NO: 13 - RNA, 2259 nt, Artificial Sequence
  scFvCD19-TM-41BB-CD3z-BFP mRNA
auggcucugccugugacagcucugcugcugccucuggcccugcugcuccaugccgccagacccggauccgauauccagaugacccagaccaccagcagccugagcgccagccugggcgauagagugaccaucagcugcagagccagccaggacaucagcaaguaccugaacugguaucagcagaaacccgacggcaccgugaagcugcugaucuaccacaccagcagacugcacagcggcgugcccagcagauuuucuggcagcggcuccggcaccgacuacagccugaccaucuccaaccuggaacaggaagauaucgcuaccuacuucugucagcaaggcaacacccugcccuacaccuucggcggaggcaccaagcuggaaaucaccggcagcacaagcggcagcggcaagccuggaucuggcgagggaagcaccaagggcgaagugaaacugcaggaaagcggcccuggacugguggccccaagccagucucugagcgugaccuguaccguguccggcgugucccugccugacuauggcguguccuggaucagacagccacccagaaagggccuggaauggcugggagugaucuggggcagcgagacaaccuacuacaacagcgcccugaagucccggcugaccaucaucaaggacaacuccaagagccagguguuccugaagaugaacagccugcagaccgacgacaccgccaucuacuacugcgccaagcacuacuacuacggcggcagcuacgccauggacuacuggggccagggcacaagcgugaccguguccagcgcuagcgccaagccuaccaccaccccugccccuagaccuccaacacccgccccaacaaucgccagccagccucugucucugaggcccgaggcuuguagaccagcugcuggcggagccgugcacaccagaggacuggauuucgccugcgacaucuacaucugggccccucuggccggcacauguggcgugcugcugcugagccucgugaucaccaugcauaaacggggcagaaagaaacuccuguauauauucaaacaaccauuuaugagaccaguacaaacuacucaagaggaagauggcuguagcugccgauuuccagaagaagaagaaggaggaugugaacugcgggugaaguucagcagaagcgccgacgccccugccuaccagcagggccagaaucagcuguacaacgagcugaaccugggcagaagggaagaguacgacguccuggauaagcggagaggccgggacccugagaugggcggcaagccucggcggaagaacccccaggaaggccuguauaacgaacugcagaaagacaagauggccgaggccuacagcgagaucggcaugaagggcgagcggaggcggggcaagggccacgacggccuguaucagggccuguccaccgccaccaaggauaccuacgacgcccugcacaugcaggcccugcccccaaggggcggccgcuccggugagggcagaggaagucuucuaacaugcggugacguggaggagaauccgggccccucuagaagcgagcugauuaaggagaacaugcacaugaagcuguacauggagggcaccguggacaaccaucacuucaagugcacauccgagggcgaaggcaagcccuacgagggcacccagaccaugagaaucaagguggucgagggcggcccucuccccuucgccuucgacauccuggcuacuagcuuccucuacggcagcaagaccuucaucaaccacacccagggcauccccgacuucuucaagcaguccuucccugagggcuucacaugggagagagucaccacauacgaagacgggggcgugcugaccgcuacccaggacaccagccuccaggacggcugccucaucuacaacgucaagaucagaggggugaacuucacauccaacggcccugugaugcagaagaaaacacucggcugggaggccuucaccgagacgcuguaccccgcugacggcggccuggaaggcagaaacgacauggcccugaagcucgugggcgggagccaucugaucgcaaacaucaagaccacauauagauccaagaaacccgcuaagaaccucaagaugccuggcgucuacuauguggacuacagacuggaaagaaucaaggaggccaacaacgagaccuacgucgagcagcacgagguggcaguggccagauacugcgaccucccuagcaaacuggggcacaagcuuaauuga

SEQ ID NO: 14 - DNA, 7597 bp, Artificial Sequence
  pCVL_T7_scFvCD19-TM-41BB-CD3z-BFP lentiviral vector
aaaaataaacaaataggggttccgcgcacatttccccgaaaagtgccacctgacgtcaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaatgaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcggttaacttttaaaagaaaaggggggattggggggtacagtgcaggggaaagaatagtagacataatagcaacagacatacaaactaaagaattacaaaaacaaattacaaaaattcaaaattttatcgattacgcgtaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacacctgcaggtaatacgactcactatagggtccactgccgccaccatggctctgcctgtgacagctctgctgctgcctctggccctgctgctccatgccgccagacccggatccgatatccagatgacccagaccaccagcagcctgagcgccagcctgggcgatagagtgaccatcagctgcagagccagccaggacatcagcaagtacctgaactggtatcagcagaaacccgacggcaccgtgaagctgctgatctaccacaccagcagactgcacagcggcgtgcccagcagattttctggcagcggctccggcaccgactacagcctgaccatctccaacctggaacaggaagatatcgctacctacttctgtcagcaaggcaacaccctgccctacaccttcggcggaggcaccaagctggaaatcaccggcagcacaagcggcagcggcaagcctggatctggcgagggaagcaccaagggcgaagtgaaactgcaggaaagcggccctggactggtggccccaagccagtctctgagcgtgacctgtaccgtgtccggcgtgtccctgcctgactatggcgtgtcctggatcagacagccacccagaaagggcctggaatggctgggagtgatctggggcagcgagacaacctactacaacagcgccctgaagtcccggctgaccatcatcaaggacaactccaagagccaggtgttcctgaagatgaacagcctgcagaccgacgacaccgccatctactactgcgccaagcactactactacggcggcagctacgccatggactactggggccagggcacaagcgtgaccgtgtccagcgctagcgccaagcctaccaccacccctgcccctagacctccaacacccgccccaacaatcgccagccagcctctgtctctgaggcccgaggcttgtagaccagctgctggcggagccgtgcacaccagaggactggatttcgcctgcgacatctacatctgggcccctctggccggcacatgtggcgtgctgctgctgagcctcgtgatcaccatgcataaacggggcagaaagaaactcctgtatatattcaaacaaccatttatgagaccagtacaaactactcaagaggaagatggctgtagctgccgatttccagaagaagaagaaggaggatgtgaactgcgggtgaagttcagcagaagcgccgacgcccctgcctaccagcagggccagaatcagctgtacaacgagctgaacctgggcagaagggaagagtacgacgtcctggataagcggagaggccgggaccctgagatgggcggcaagcctcggcggaagaacccccaggaaggcctgtataacgaactgcagaaagacaagatggccgaggcctacagcgagatcggcatgaagggcgagcggaggcggggcaagggccacgacggcctgtatcagggcctgtccaccgccaccaaggatacctacgacgccctgcacatgcaggccctgcccccaaggggcggccgctccggtgagggcagaggaagtcttctaacatgcggtgacgtggaggagaatccgggcccctctagaagcgagctgattaaggagaacatgcacatgaagctgtacatggagggcaccgtggacaaccatcacttcaagtgcacatccgagggcgaaggcaagccctacgagggcacccagaccatgagaatcaaggtggtcgagggcggccctctccccttcgccttcgacatcctggctactagcttcctctacggcagcaagaccttcatcaaccacacccagggcatccccgacttcttcaagcagtccttccctgagggcttcacatgggagagagtcaccacatacgaagacgggggcgtgctgaccgctacccaggacaccagcctccaggacggctgcctcatctacaacgtcaagatcagaggggtgaacttcacatccaacggccctgtgatgcagaagaaaacactcggctgggaggccttcaccgagacgctgtaccccgctgacggcggcctggaaggcagaaacgacatggccctgaagctcgtgggcgggagccatctgatcgcaaacatcaagaccacatatagatccaagaaacccgctaagaacctcaagatgcctggcgtctactatgtggactacagactggaaagaatcaaggaggccaacaacgagacctacgtcgagcagcacgaggtggcagtggccagatactgcgacctccctagcaaactggggcacaagcttaattgagtcgaccgagcatcttaccgccatttatacccatatttgttctgtttttcttgatttgggtatacatttaaatgttaatagaacaaaatggtggggcaatcatttacatttttagggatatgtaattactagttcaggtgtattgccacaagacaaacatgttaagaaactttcccgttatttacgctctgttcctgttaatcaacctctggattacaaaatttgtgaaagattgactgatattcttaactatgttgctccttttacgctgtgtggatatgctgctttatagcctctgtatctagctattgcttcccgtacggctttcgttttctcctccttgtataaatcctggttgctgtctcttttagaggagttgtggcccgttgtccgtcaacgtggcgtggtgtgctctgtgtttgctgacgcaacccccactggctggggcattgccaccacctgtcaactcctttctgggactttcgctttccccctcccgatcgccacggcagaactcatcgccgcctgccttgcccgctgctggacaggggctaggttgctgggcactgataattccgtggtgttgtcatcgaattcggtacctttttaaaagaaaaggggggactggaagggctaattcactcccaacgaagacaagatatcataacttcgtatagcatacattatacgaagttataatttatttgtgaaatttgtgatgctattgctttatttgtaaccatatgtttatttgtgaaatttgtgatgctattgctttatttgtaaccattgctttttgcttgtactgggtctctctggttagaccagatctgagcctgggagctctctggctaactagggaacccactgcttaagcctcaataaagcttgcctcgaccagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcctgcagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttag

SEQ ID NO: 15 - protein, 324 aa, Artificial Sequence
  DmrC-TM-41BB-CD3z protein
MGSILWHEMWHEGLEEASRLYFGERNVKGMFEVLEPLHAMMERGPQTLKETSFNQAYGRDLMEAQEWCRKYMKSGNVKDLLQAWDLYYHVFRRISKASAKPTTTPAPRPPTPAPTIASQPLSLRPEACRPAAGGAVHTRGLDFACDIYIWAPLAGTCGVLLLSLVITMHKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRG

SEQ ID NO: 16 - RNA, 1032 nt, Artificial Sequence
  SS-DmrC-TM-41BB-CD3z mRNA
auggcucugccugugacagcucugcugcugccucuggcccugcugcuccaugccgccagacccggauccauccucuggcaugagauguggcaugaaggccuggaagaggcaucucguuuguacuuuggggaaaggaacgugaaaggcauguuugaggugcuggagcccuugcaugcuaugauggaacggggcccccagacucugaaggaaacauccuuuaaucaggccuauggucgagauuuaauggaggcccaagaguggugcaggaaguacaugaaaucagggaaugucaaggaccuccuccaagccugggaccucuauuaucauguguuccgacgaaucucaaaggcuagcgccaagccuaccaccaccccugccccuagaccuccaacacccgccccaacaaucgccagccagccucugucucugaggcccgaggcuuguagaccagcugcuggcggagccgugcacaccagaggacuggauuucgccugcgacaucuacaucugggccccucuggccggcacauguggcgugcugcugcugagccucgugaucaccaugcauaaacggggcagaaagaaacuccuguauauauucaaacaaccauuuaugagaccaguacaaacuacucaagaggaagauggcuguagcugccgauuuccagaagaagaagaaggaggaugugaacugcgggugaaguucagcagaagcgccgacgccccugccuaccagcagggccagaaucagcuguacaacgagcugaaccugggcagaagggaagaguacgacguccuggauaagcggagaggccgggacccugagaugggcggcaagccucggcggaagaacccccaggaaggccuguauaacgaacugcagaaagacaagauggccgaggccuacagcgagaucggcaugaagggcgagcggaggcggggcaagggccacgacggccuguaucagggccuguccaccgccaccaaggauaccuacgacgcccugcacaugcaggcccugcccccaaggggc

SEQ ID NO: 17 - DNA, 1032 bp, Artificial Sequence
  SS-DmrC-TM-41BB-CD3z DNA
atggctctgcctgtgacagctctgctgctgcctctggccctgctgctccatgccgccagacccggatccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcctccaagcctgggacctctattatcatgtgttccgacgaatctcaaaggctagcgccaagcctaccaccacccctgcccctagacctccaacacccgccccaacaatcgccagccagcctctgtctctgaggcccgaggcttgtagaccagctgctggcggagccgtgcacaccagaggactggatttcgcctgcgacatctacatctgggcccctctggccggcacatgtggcgtgctgctgctgagcctcgtgatcaccatgcataaacggggcagaaagaaactcctgtatatattcaaacaaccatttatgagaccagtacaaactactcaagaggaagatggctgtagctgccgatttccagaagaagaagaaggaggatgtgaactgcgggtgaagttcagcagaagcgccgacgcccctgcctaccagcagggccagaatcagctgtacaacgagctgaacctgggcagaagggaagagtacgacgtcctggataagcggagaggccgggaccctgagatgggcggcaagcctcggcggaagaacccccaggaaggcctgtataacgaactgcagaaagacaagatggccgaggcctacagcgagatcggcatgaagggcgagcggaggcggggcaagggccacgacggcctgtatcagggcctgtccaccgccaccaaggatacctacgacgccctgcacatgcaggccctgcccccaaggggc

SEQ ID NO: 18 - DNA, 1512 bp, Artificial Sequence
  SS-DmrC-spacer-TM-41BB-CD3z DNA
atggctctgcctgtgacagctctgctgctgcctctggccctgctgctccatgccgccagacccggatccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcctccaagcctgggacctctattatcatgtgttccgacgaatctcaaaggctagcgagagcaagtacggaccgccctgcccaccttgccctgcccccgagttcctgggcggacccagcgtgttcctgttcccacccaagcccaaggacaccctgatgatcagccggacccccgaggtgacctgcgtggtggtggacgtgagccaggaagatcccgaggtccagttcaattggtacgtggacggcgtggaagtgcacaacgccaagaccaagcccagagaggaacagttcaacagcacctaccgggtggtgtctgtgctgaccgtgctgcaccaggactggctgaacggcaaagaatacaagtgcaaggtgtccaacaagggcctgcccagcagcatcgaaaagaccatcagcaaggccaagggccagcctcgcgagccccaggtgtacaccctgcctccctcccaggaagagatgaccaagaaccaggtgtccctgacctgcctggtgaagggcttctaccccagcgacatcgccgtggagtgggagagcaacggccagcctgagaacaactacaagaccacccctcccgtgctggacagcgacggcagcttcttcctgtacagccggctgaccgtggacaagagccggtggcaggaaggcaacgtctttagctgcagcgtgatgcacgaggccctgcacaaccactacacccagaagagcctgagcctgtccctgggcaagatgcataaacggggcagaaagaaactcctgtatatattcaaacaaccatttatgagaccagtacaaactactcaagaggaagatggctgtagctgccgatttccagaagaagaagaaggaggatgtgaactgcgggtgaagttcagcagaagcgccgacgcccctgcctaccagcagggccagaatcagctgtacaacgagctgaacctgggcagaagggaagagtacgacgtcctggataagcggagaggccgggaccctgagatgggcggcaagcctcggcggaagaacccccaggaaggcctgtataacgaactgcagaaagacaagatggccgaggcctacagcgagatcggcatgaagggcgagcggaggcggggcaagggccacgacggcctgtatcagggcctgtccaccgccaccaaggatacctacgacgccctgcacatgcaggccctgcccccaaggggc

SEQ ID NO: 19 - protein, 338 aa, Artificial Sequence
  DmrB-TM-41BB-CD3z protein
MGSGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEASAKPTTTPAPRPPTPAPTIASQPLSLRPEACRPAAGGAVHTRGLDFACDIYIWAPLAGTCGVLLLSLVITMHKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRG

SEQ ID NO: 20 - RNA, 1074 nt, Artificial Sequence
  SS-DmrB-TM-41BB-CD3z mRNA
auggcucugccugugacagcucugcugcugccucuggcccugcugcuccaugccgccagacccggauccggagugcagguggaaaccaucuccccaggagacgggcgcaccuuccccaagcgcggccagaccugcguggugcacuacaccgggaugcuugaagauggaaagaaaguugauuccucccgggacagaaacaagcccuuuaaguuuaugcuaggcaagcaggaggugauccgaggcugggaagaagggguugcccagaugagugugggucagagagccaaacugacuauaucuccagauuaugccuauggugccacugggcacccaggcaucaucccaccacaugccacucucgucuucgauguggagcuucuaaaacuggaagcuagcgccaagccuaccaccaccccugccccuagaccuccaacacccgccccaacaaucgccagccagccucugucucugaggcccgaggcuuguagaccagcugcuggcggagccgugcacaccagaggacuggauuucgccugcgacaucuacaucugggccccucuggccggcacauguggcgugcugcugcugagccucgugaucaccaugcauaaacggggcagaaagaaacuccuguauauauucaaacaaccauuuaugagaccaguacaaacuacucaagaggaagauggcuguagcugccgauuuccagaagaagaagaaggaggaugugaacugcgggugaaguucagcagaagcgccgacgccccugccuaccagcagggccagaaucagcuguacaacgagcugaaccugggcagaagggaagaguacgacguccuggauaagcggagaggccgggacccugagaugggcggcaagccucggcggaagaacccccaggaaggccuguauaacgaacugcagaaagacaagauggccgaggccuacagcgagaucggcaugaagggcgagcggaggcggggcaagggccacgacggccuguaucagggccuguccaccgccaccaaggauaccuacgacgcccugcacaugcaggcccugcccccaaggggc

SEQ ID NO: 21 - DNA, 1074 bp, Artificial Sequence
  SS-DmrB-TM-41BB-CD3z DNA
atggctctgcctgtgacagctctgctgctgcctctggccctgctgctccatgccgccagacccggatccggagtgcaggtggaaaccatctccccaggagacgggcgcaccttccccaagcgcggccagacctgcgtggtgcactacaccgggatgcttgaagatggaaagaaagttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaagctagcgccaagcctaccaccacccctgcccctagacctccaacacccgccccaacaatcgccagccagcctctgtctctgaggcccgaggcttgtagaccagctgctggcggagccgtgcacaccagaggactggatttcgcctgcgacatctacatctgggcccctctggccggcacatgtggcgtgctgctgctgagcctcgtgatcaccatgcataaacggggcagaaagaaactcctgtatatattcaaacaaccatttatgagaccagtacaaactactcaagaggaagatggctgtagctgccgatttccagaagaagaagaaggaggatgtgaactgcgggtgaagttcagcagaagcgccgacgcccctgcctaccagcagggccagaatcagctgtacaacgagctgaacctgggcagaagggaagagtacgacgtcctggataagcggagaggccgggaccctgagatgggcggcaagcctcggcggaagaacccccaggaaggcctgtataacgaactgcagaaagacaagatggccgaggcctacagcgagatcggcatgaagggcgagcggaggcggggcaagggccacgacggcctgtatcagggcctgtccaccgccaccaaggatacctacgacgccctgcacatgcaggccctgcccccaaggggc

SEQ ID NO: 22 - DNA, 1554 bp, Artificial Sequence
  SS-DmrB-spacer-TM-41BB-CD3z DNA
atggctctgcctgtgacagctctgctgctgcctctggccctgctgctccatgccgccagacccggatccggagtgcaggtggaaaccatctccccaggagacgggcgcaccttccccaagcgcggccagacctgcgtggtgcactacaccgggatgcttgaagatggaaagaaagttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaagctagcgagagcaagtacggaccgccctgcccaccttgccctgcccccgagttcctgggcggacccagcgtgttcctgttcccacccaagcccaaggacaccctgatgatcagccggacccccgaggtgacctgcgtggtggtggacgtgagccaggaagatcccgaggtccagttcaattggtacgtggacggcgtggaagtgcacaacgccaagaccaagcccagagaggaacagttcaacagcacctaccgggtggtgtctgtgctgaccgtgctgcaccaggactggctgaacggcaaagaatacaagtgcaaggtgtccaacaagggcctgcccagcagcatcgaaaagaccatcagcaaggccaagggccagcctcgcgagccccaggtgtacaccctgcctccctcccaggaagagatgaccaagaaccaggtgtccctgacctgcctggtgaagggcttctaccccagcgacatcgccgtggagtgggagagcaacggccagcctgagaacaactacaagaccacccctcccgtgctggacagcgacggcagcttcttcctgtacagccggctgaccgtggacaagagccggtggcaggaaggcaacgtctttagctgcagcgtgatgcacgaggccctgcacaaccactacacccagaagagcctgagcctgtccctgggcaagatgcataaacggggcagaaagaaactcctgtatatattcaaacaaccatttatgagaccagtacaaactactcaagaggaagatggctgtagctgccgatttccagaagaagaagaaggaggatgtgaactgcgggtgaagttcagcagaagcgccgacgcccctgcctaccagcagggccagaatcagctgtacaacgagctgaacctgggcagaagggaagagtacgacgtcctggataagcggagaggccgggaccctgagatgggcggcaagcctcggcggaagaacccccaggaaggcctgtataacgaactgcagaaagacaagatggccgaggcctacagcgagatcggcatgaagggcgagcggaggcggggcaagggccacgacggcctgtatcagggcctgtccaccgccaccaaggatacctacgacgccctgcacatgcaggccctgcccccaaggggc

SEQ ID NO: 23 - protein, 338 aa, Artificial Sequence
  DmrA-TM-41BB-CD3z protein
MGSGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLEASAKPTTTPAPRPPTPAPTIASQPLSLRPEACRPAAGGAVHTRGLDFACDIYIWAPLAGTCGVLLLSLVITMHKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRG

SEQ ID NO: 24 - RNA, 1074 nt, Artificial Sequence
  DmrA-TM-41BB-CD3z mRNA
auggcucugccugugacagcucugcugcugccucuggcccugcugcuccaugccgccagacccggauccggagugcagguggaaaccaucuccccaggagacgggcgcaccuuccccaagcgcggccagaccugcguggugcacuacaccgggaugcuugaagauggaaagaaauuugauuccucccgggacagaaacaagcccuuuaaguuuaugcuaggcaagcaggaggugauccgaggcugggaagaagggguugcccagaugagugugggucagagagccaaacugacuauaucuccagauuaugccuauggugccacugggcacccaggcaucaucccaccacaugccacucucgucuucgauguggagcuucuaaaacuggaagcuagcgccaagccuaccaccaccccugccccuagaccuccaacacccgccccaacaaucgccagccagccucugucucugaggcccgaggcuuguagaccagcugcuggcggagccgugcacaccagaggacuggauuucgccugcgacaucuacaucugggccccucuggccggcacauguggcgugcugcugcugagccucgugaucaccaugcauaaacggggcagaaagaaacuccuguauauauucaaacaaccauuuaugagaccaguacaaacuacucaagaggaagauggcuguagcugccgauuuccagaagaagaagaaggaggaugugaacugcgggugaaguucagcagaagcgccgacgccccugccuaccagcagggccagaaucagcuguacaacgagcugaaccugggcagaagggaagaguacgacguccuggauaagcggagaggccgggacccugagaugggcggcaagccucggcggaagaacccccaggaaggccuguauaacgaacugcagaaagacaagauggccgaggccuacagcgagaucggcaugaagggcgagcggaggcggggcaagggccacgacggccuguaucagggccuguccaccgccaccaaggauaccuacgacgcccugcacaugcaggcccugcccccaaggggc

SEQ ID NO: 25 - DNA, 1074 bp, Artificial Sequence
  DmrA-TM-41BB-CD3z DNA
atggctctgcctgtgacagctctgctgctgcctctggccctgctgctccatgccgccagacccggatccggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaagctagcgccaagcctaccaccacccctgcccctagacctccaacacccgccccaacaatcgccagccagcctctgtctctgaggcccgaggcttgtagaccagctgctggcggagccgtgcacaccagaggactggatttcgcctgcgacatctacatctgggcccctctggccggcacatgtggcgtgctgctgctgagcctcgtgatcaccatgcataaacggggcagaaagaaactcctgtatatattcaaacaaccatttatgagaccagtacaaactactcaagaggaagatggctgtagctgccgatttccagaagaagaagaaggaggatgtgaactgcgggtgaagttcagcagaagcgccgacgcccctgcctaccagcagggccagaatcagctgtacaacgagctgaacctgggcagaagggaagagtacgacgtcctggataagcggagaggccgggaccctgagatgggcggcaagcctcggcggaagaacccccaggaaggcctgtataacgaactgcagaaagacaagatggccgaggcctacagcgagatcggcatgaagggcgagcggaggcggggcaagggccacgacggcctgtatcagggcctgtccaccgccaccaaggatacctacgacgccctgcacatgcaggccctgcccccaaggggc

SEQ ID NO: 26 - DNA, 1554 bp, Artificial Sequence
  DmrA-spacer-TM-41BB-CD3z DNA
atggctctgcctgtgacagctctgctgctgcctctggccctgctgctccatgccgccagacccggatccggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaagctagcgagagcaagtacggaccgccctgcccaccttgccctgcccccgagttcctgggcggacccagcgtgttcctgttcccacccaagcccaaggacaccctgatgatcagccggacccccgaggtgacctgcgtggtggtggacgtgagccaggaagatcccgaggtccagttcaattggtacgtggacggcgtggaagtgcacaacgccaagaccaagcccagagaggaacagttcaacagcacctaccgggtggtgtctgtgctgaccgtgctgcaccaggactggctgaacggcaaagaatacaagtgcaaggtgtccaacaagggcctgcccagcagcatcgaaaagaccatcagcaaggccaagggccagcctcgcgagccccaggtgtacaccctgcctccctcccaggaagagatgaccaagaaccaggtgtccctgacctgcctggtgaagggcttctaccccagcgacatcgccgtggagtgggagagcaacggccagcctgagaacaactacaagaccacccctcccgtgctggacagcgacggcagcttcttcctgtacagccggctgaccgtggacaagagccggtggcaggaaggcaacgtctttagctgcagcgtgatgcacgaggccctgcacaaccactacacccagaagagcctgagcctgtccctgggcaagatgcataaacggggcagaaagaaactcctgtatatattcaaacaaccatttatgagaccagtacaaactactcaagaggaagatggctgtagctgccgatttccagaagaagaagaaggaggatgtgaactgcgggtgaagttcagcagaagcgccgacgcccctgcctaccagcagggccagaatcagctgtacaacgagctgaacctgggcagaagggaagagtacgacgtcctggataagcggagaggccgggaccctgagatgggcggcaagcctcggcggaagaacccccaggaaggcctgtataacgaactgcagaaagacaagatggccgaggcctacagcgagatcggcatgaagggcgagcggaggcggggcaagggccacgacggcctgtatcagggcctgtccaccgccaccaaggatacctacgacgccctgcacatgcaggccctgcccccaaggggc

SEQ ID NO: 27 - DNA, 7141 bp, Artificial Sequence
  pCVL_T7_DmrC-TM-41BB-CD3z lentiviral vector
aaaaataaacaaataggggttccgcgcacatttccccgaaaagtgccacctgacgtcaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaatgaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcggttaacttttaaaagaaaaggggggattggggggtacagtgcaggggaaagaatagtagacataatagcaacagacatacaaactaaagaattacaaaaacaaattacaaaaattcaaaattttatcgattacgcgtaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacacctgcaggtaatacgactcactatagggtccactgccgccaccatggctctgcctgtgacagctctgctgctgcctctggccctgctgctccatgccgccagacccggatccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcctccaagcctgggacctctattatcatgtgttccgacgaatctcaaaggctagcgccaagcctaccaccacccctgcccctagacctccaacacccgccccaacaatcgccagccagcctctgtctctgaggcccgaggcttgtagaccagctgctggcggagccgtgcacaccagaggactggatttcgcctgcgacatctacatctgggcccctctggccggcacatgtggcgtgctgctgctgagcctcgtgatcaccatgcataaacggggcagaaagaaactcctgtatatattcaaacaaccatttatgagaccagtacaaactactcaagaggaagatggctgtagctgccgatttccagaagaagaagaaggaggatgtgaactgcgggtgaagttcagcagaagcgccgacgcccctgcctaccagcagggccagaatcagctgtacaacgagctgaacctgggcagaagggaagagtacgacgtcctggataagcggagaggccgggaccctgagatgggcggcaagcctcggcggaagaacccccaggaaggcctgtataacgaactgcagaaagacaagatggccgaggcctacagcgagatcggcatgaagggcgagcggaggcggggcaagggccacgacggcctgtatcagggcctgtccaccgccaccaaggatacctacgacgccctgcacatgcaggccctgcccccaaggggcggccgctccggtgagggcagaggaagtcttctaacatgcggtgacgtggaggagaatccgggcccctctagaagcgagctgattaaggagaacatgcacatgaagctgtacatggagggcaccgtggacaaccatcacttcaagtgcacatccgagggcgaaggcaagccctacgagggcacccagaccatgagaatcaaggtggtcgagggcggccctctccccttcgccttcgacatcctggctactagcttcctctacggcagcaagaccttcatcaaccacacccagggcatccccgacttcttcaagcagtccttccctgagggcttcacatgggagagagtcaccacatacgaagacgggggcgtgctgaccgctacccaggacaccagcctccaggacggctgcctcatctacaacgtcaagatcagaggggtgaacttcacatccaacggccctgtgatgcagaagaaaacactcggctgggaggccttcaccgagacgctgtaccccgctgacggcggcctggaaggcagaaacgacatggccctgaagctcgtgggcgggagccatctgatcgcaaacatcaagaccacatatagatccaagaaacccgctaagaacctcaagatgcctggcgtctactatgtggactacagactggaaagaatcaaggaggccaacaacgagacctacgtcgagcagcacgaggtggcagtggccagatactgcgacctccctagcaaactggggcacaagcttaattgagtcgaccgagcatcttaccgccatttatacccatatttgttctgtttttcttgatttgggtatacatttaaatgttaatagaacaaaatggtggggcaatcatttacatttttagggatatgtaattactagttcaggtgtattgccacaagacaaacatgttaagaaactttcccgttatttacgctctgttcctgttaatcaacctctggattacaaaatttgtgaaagattgactgatattcttaactatgttgctccttttacgctgtgtggatatgctgctttatagcctctgtatctagctattgcttcccgtacggctttcgttttctcctccttgtataaatcctggttgctgtctcttttagaggagttgtggcccgttgtccgtcaacgtggcgtggtgtgctctgtgtttgctgacgcaacccccactggctggggcattgccaccacctgtcaactcctttctgggactttcgctttccccctcccgatcgccacggcagaactcatcgccgcctgccttgcccgctgctggacaggggctaggttgctgggcactgataattccgtggtgttgtcatcgaattcggtacctttttaaaagaaaaggggggactggaagggctaattcactcccaacgaagacaagatatcataacttcgtatagcatacattatacgaagttataatttatttgtgaaatttgtgatgctattgctttatttgtaaccatatgtttatttgtgaaatttgtgatgctattgctttatttgtaaccattgctttttgcttgtactgggtctctctggttagaccagatctgagcctgggagctctctggctaactagggaacccactgcttaagcctcaataaagcttgcctcgaccagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcctgcagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttag

SEQ ID NO: 28 - DNA, 7621 bp, Artificial Sequence
  pCVL_T7_DmrC-spacer-TM-41BB-CD3z lentiviral vector
aaaaataaacaaataggggttccgcgcacatttccccgaaaagtgccacctgacgtcaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaatgaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcggttaacttttaaaagaaaaggggggattggggggtacagtgcaggggaaagaatagtagacataatagcaacagacatacaaactaaagaattacaaaaacaaattacaaaaattcaaaattttatcgattacgcgtaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacacctgcaggtaatacgactcactatagggtccactgccgccaccatggctctgcctgtgacagctctgctgctgcctctggccctgctgctccatgccgccagacccggatccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcctccaagcctgggacctctattatcatgtgttccgacgaatctcaaaggctagcgagagcaagtacggaccgccctgcccaccttgccctgcccccgagttcctgggcggacccagcgtgttcctgttcccacccaagcccaaggacaccctgatgatcagccggacccccgaggtgacctgcgtggtggtggacgtgagccaggaagatcccgaggtccagttcaattggtacgtggacggcgtggaagtgcacaacgccaagaccaagcccagagaggaacagttcaacagcacctaccgggtggtgtctgtgctgaccgtgctgcaccaggactggctgaacggcaaagaatacaagtgcaaggtgtccaacaagggcctgcccagcagcatcgaaaagaccatcagcaaggccaagggccagcctcgcgagccccaggtgtacaccctgcctccctcccaggaagagatgaccaagaaccaggtgtccctgacctgcctggtgaagggcttctaccccagcgacatcgccgtggagtgggagagcaacggccagcctgagaacaactacaagaccacccctcccgtgctggacagcgacggcagcttcttcctgtacagccggctgaccgtggacaagagccggtggcaggaaggcaacgtctttagctgcagcgtgatgcacgaggccctgcacaaccactacacccagaagagcctgagcctgtccctgggcaagatgcataaacggggcagaaagaaactcctgtatatattcaaacaaccatttatgagaccagtacaaactactcaagaggaagatggctgtagctgccgatttccagaagaagaagaaggaggatgtgaactgcgggtgaagttcagcagaagcgccgacgcccctgcctaccagcagggccagaatcagctgtacaacgagctgaacctgggcagaagggaagagtacgacgtcctggataagcggagaggccgggaccctgagatgggcggcaagcctcggcggaagaacccccaggaaggcctgtataacgaactgcagaaagacaagatggccgaggcctacagcgagatcggcatgaagggcgagcggaggcggggcaagggccacgacggcctgtatcagggcctgtccaccgccaccaaggatacctacgacgccctgcacatgcaggccctgcccccaaggggcggccgctccggtgagggcagaggaagtcttctaacatgcggtgacgtggaggagaatccgggcccctctagaagcgagctgattaaggagaacatgcacatgaagctgtacatggagggcaccgtggacaaccatcacttcaagtgcacatccgagggcgaaggcaagccctacgagggcacccagaccatgagaatcaaggtggtcgagggcggccctctccccttcgccttcgacatcctggctactagcttcctctacggcagcaagaccttcatcaaccacacccagggcatccccgacttcttcaagcagtccttccctgagggcttcacatgggagagagtcaccacatacgaagacgggggcgtgctgaccgctacccaggacaccagcctccaggacggctgcctcatctacaacgtcaagatcagaggggtgaacttcacatccaacggccctgtgatgcagaagaaaacactcggctgggaggccttcaccgagacgctgtaccccgctgacggcggcctggaaggcagaaacgacatggccctgaagctcgtgggcgggagccatctgatcgcaaacatcaagaccacatatagatccaagaaacccgctaagaacctcaagatgcctggcgtctactatgtggactacagactggaaagaatcaaggaggccaacaacgagacctacgtcgagcagcacgaggtggcagtggccagatactgcgacctccctagcaaactggggcacaagcttaattgagtcgaccgagcatcttaccgccatttatacccatatttgttctgtttttcttgatttgggtatacatttaaatgttaatagaacaaaatggtggggcaatcatttacatttttagggatatgtaattactagttcaggtgtattgccacaagacaaacatgttaagaaactttcccgttatttacgctctgttcctgttaatcaacctctggattacaaaatttgtgaaagattgactgatattcttaactatgttgctccttttacgctgtgtggatatgctgctttatagcctctgtatctagctattgcttcccgtacggctttcgttttctcctccttgtataaatcctggttgctgtctcttttagaggagttgtggcccgttgtccgtcaacgtggcgtggtgtgctctgtgtttgctgacgcaacccccactggctggggcattgccaccacctgtcaactcctttctgggactttcgctttccccctcccgatcgccacggcagaactcatcgccgcctgccttgcccgctgctggacaggggctaggttgctgggcactgataattccgtggtgttgtcatcgaattcggtacctttttaaaagaaaaggggggactggaagggctaattcactcccaacgaagacaagatatcataacttcgtatagcatacattatacgaagttataatttatttgtgaaatttgtgatgctattgctttatttgtaaccatatgtttatttgtgaaatttgtgatgctattgctttatttgtaaccattgctttttgcttgtactgggtctctctggttagaccagatctgagcctgggagctctctggctaactagggaacccactgcttaagcctcaataaagcttgcctcgaccagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcctgcagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttag

SEQ ID NO: 29 - DNA, 7183 bp, Artificial Sequence
  pCVL_T7_DmrB-TM-41BB-CD3z lentiviral vector
aaaaataaacaaataggggttccgcgcacatttccccgaaaagtgccacctgacgtcaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaatgaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcggttaacttttaaaagaaaaggggggattggggggtacagtgcaggggaaagaatagtagacataatagcaacagacatacaaactaaagaattacaaaaacaaattacaaaaattcaaaattttatcgattacgcgtaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacacctgcaggtaatacgactcactatagggtccactgccgccaccatggctctgcctgtgacagctctgctgctgcctctggccctgctgctccatgccgccagacccggatccggagtgcaggtggaaaccatctccccaggagacgggcgcaccttccccaagcgcggccagacctgcgtggtgcactacaccgggatgcttgaagatggaaagaaagttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaagctagcgccaagcctaccaccacccctgcccctagacctccaacacccgccccaacaatcgccagccagcctctgtctctgaggcccgaggcttgtagaccagctgctggcggagccgtgcacaccagaggactggatttcgcctgcgacatctacatctgggcccctctggccggcacatgtggcgtgctgctgctgagcctcgtgatcaccatgcataaacggggcagaaagaaactcctgtatatattcaaacaaccatttatgagaccagtacaaactactcaagaggaagatggctgtagctgccgatttccagaagaagaagaaggaggatgtgaactgcgggtgaagttcagcagaagcgccgacgcccctgcctaccagcagggccagaatcagctgtacaacgagctgaacctgggcagaagggaagagtacgacgtcctggataagcggagaggccgggaccctgagatgggcggcaagcctcggcggaagaacccccaggaaggcctgtataacgaactgcagaaagacaagatggccgaggcctacagcgagatcggcatgaagggcgagcggaggcggggcaagggccacgacggcctgtatcagggcctgtccaccgccaccaaggatacctacgacgccctgcacatgcaggccctgcccccaaggggcggccgctccggtgagggcagaggaagtcttctaacatgcggtgacgtggaggagaatccgggcccctctagaagcgagctgattaaggagaacatgcacatgaagctgtacatggagggcaccgtggacaaccatcacttcaagtgcacatccgagggcgaaggcaagccctacgagggcacccagaccatgagaatcaaggtggtcgagggcggccctctccccttcgccttcgacatcctggctactagcttcctctacggcagcaagaccttcatcaaccacacccagggcatccccgacttcttcaagcagtccttccctgagggcttcacatgggagagagtcaccacatacgaagacgggggcgtgctgaccgctacccaggacaccagcctccaggacggctgcctcatctacaacgtcaagatcagaggggtgaacttcacatccaacggccctgtgatgcagaagaaaacactcggctgggaggccttcaccgagacgctgtaccccgctgacggcggcctggaaggcagaaacgacatggccctgaagctcgtgggcgggagccatctgatcgcaaacatcaagaccacatatagatccaagaaacccgctaagaacctcaagatgcctggcgtctactatgtggactacagactggaaagaatcaaggaggccaacaacgagacctacgtcgagcagcacgaggtggcagtggccagatactgcgacctccctagcaaactggggcacaagcttaattgagtcgaccgagcatcttaccgccatttatacccatatttgttctgtttttcttgatttgggtatacatttaaatgttaatagaacaaaatggtggggcaatcatttacatttttagggatatgtaattactagttcaggtgtattgccacaagacaaacatgttaagaaactttcccgttatttacgctctgttcctgttaatcaacctctggattacaaaatttgtgaaagattgactgatattcttaactatgttgctccttttacgctgtgtggatatgctgctttatagcctctgtatctagctattgcttcccgtacggctttcgttttctcctccttgtataaatcctggttgctgtctcttttagaggagttgtggcccgttgtccgtcaacgtggcgtggtgtgctctgtgtttgctgacgcaacccccactggctggggcattgccaccacctgtcaactcctttctgggactttcgctttccccctcccgatcgccacggcagaactcatcgccgcctgccttgcccgctgctggacaggggctaggttgctgggcactgataattccgtggtgttgtcatcgaattcggtacctttttaaaagaaaaggggggactggaagggctaattcactcccaacgaagacaagatatcataacttcgtatagcatacattatacgaagttataatttatttgtgaaatttgtgatgctattgctttatttgtaaccatatgtttatttgtgaaatttgtgatgctattgctttatttgtaaccattgctttttgcttgtactgggtctctctggttagaccagatctgagcctgggagctctctggctaactagggaacccactgcttaagcctcaataaagcttgcctcgaccagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcctgcagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttag

SEQ ID NO: 30 - DNA, 7663 bp, Artificial Sequence
  pCVL_T7_DmrB-spacer-TM-41BB-CD3z lentiviral vector
aaaaataaacaaataggggttccgcgcacatttccccgaaaagtgccacctgacgtcaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaatgaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcggttaacttttaaaagaaaaggggggattggggggtacagtgcaggggaaagaatagtagacataatagcaacagacatacaaactaaagaattacaaaaacaaattacaaaaattcaaaattttatcgattacgcgtaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacacctgcaggtaatacgactcactatagggtccactgccgccaccatggctctgcctgtgacagctctgctgctgcctctggccctgctgctccatgccgccagacccggatccggagtgcaggtggaaaccatctccccaggagacgggcgcaccttccccaagcgcggccagacctgcgtggtgcactacaccgggatgcttgaagatggaaagaaagttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaagctagcgagagcaagtacggaccgccctgcccaccttgccctgcccccgagttcctgggcggacccagcgtgttcctgttcccacccaagcccaaggacaccctgatgatcagccggacccccgaggtgacctgcgtggtggtggacgtgagccaggaagatcccgaggtccagttcaattggtacgtggacggcgtggaagtgcacaacgccaagaccaagcccagagaggaacagttcaacagcacctaccgggtggtgtctgtgctgaccgtgctgcaccaggactggctgaacggcaaagaatacaagtgcaaggtgtccaacaagggcctgcccagcagcatcgaaaagaccatcagcaaggccaagggccagcctcgcgagccccaggtgtacaccctgcctccctcccaggaagagatgaccaagaaccaggtgtccctgacctgcctggtgaagggcttctaccccagcgacatcgccgtggagtgggagagcaacggccagcctgagaacaactacaagaccacccctcccgtgctggacagcgacggcagcttcttcctgtacagccggctgaccgtggacaagagccggtggcaggaaggcaacgtctttagctgcagcgtgatgcacgaggccctgcacaaccactacacccagaagagcctgagcctgtccctgggcaagatgcataaacggggcagaaagaaactcctgtatatattcaaacaaccatttatgagaccagtacaaactactcaagaggaagatggctgtagctgccgatttccagaagaagaagaaggaggatgtgaactgcgggtgaagttcagcagaagcgccgacgcccctgcctaccagcagggccagaatcagctgtacaacgagctgaacctgggcagaagggaagagtacgacgtcctggataagcggagaggccgggaccctgagatgggcggcaagcctcggcggaagaacccccaggaaggcctgtataacgaactgcagaaagacaagatggccgaggcctacagcgagatcggcatgaagggcgagcggaggcggggcaagggccacgacggcctgtatcagggcctgtccaccgccaccaaggatacctacgacgccctgcacatgcaggccctgcccccaaggggcggccgctccggtgagggcagaggaagtcttctaacatgcggtgacgtggaggagaatccgggcccctctagaagcgagctgattaaggagaacatgcacatgaagctgtacatggagggcaccgtggacaaccatcacttcaagtgcacatccgagggcgaaggcaagccctacgagggcacccagaccatgagaatcaaggtggtcgagggcggccctctccccttcgccttcgacatcctggctactagcttcctctacggcagcaagaccttcatcaaccacacccagggcatccccgacttcttcaagcagtccttccctgagggcttcacatgggagagagtcaccacatacgaagacgggggcgtgctgaccgctacccaggacaccagcctccaggacggctgcctcatctacaacgtcaagatcagaggggtgaacttcacatccaacggccctgtgatgcagaagaaaacactcggctgggaggccttcaccgagacgctgtaccccgctgacggcggcctggaaggcagaaacgacatggccctgaagctcgtgggcgggagccatctgatcgcaaacatcaagaccacatatagatccaagaaacccgctaagaacctcaagatgcctggcgtctactatgtggactacagactggaaagaatcaaggaggccaacaacgagacctacgtcgagcagcacgaggtggcagtggccagatactgcgacctccctagcaaactggggcacaagcttaattgagtcgaccgagcatcttaccgccatttatacccatatttgttctgtttttcttgatttgggtatacatttaaatgttaatagaacaaaatggtggggcaatcatttacatttttagggatatgtaattactagttcaggtgtattgccacaagacaaacatgttaagaaactttcccgttatttacgctctgttcctgttaatcaacctctggattacaaaatttgtgaaagattgactgatattcttaactatgttgctccttttacgctgtgtggatatgctgctttatagcctctgtatctagctattgcttcccgtacggctttcgttttctcctccttgtataaatcctggttgctgtctcttttagaggagttgtggcccgttgtccgtcaacgtggcgtggtgtgctctgtgtttgctgacgcaacccccactggctggggcattgccaccacctgtcaactcctttctgggactttcgctttccccctcccgatcgccacggcagaactcatcgccgcctgccttgcccgctgctggacaggggctaggttgctgggcactgataattccgtggtgttgtcatcgaattcggtacctttttaaaagaaaaggggggactggaagggctaattcactcccaacgaagacaagatatcataacttcgtatagcatacattatacgaagttataatttatttgtgaaatttgtgatgctattgctttatttgtaaccatatgtttatttgtgaaatttgtgatgctattgctttatttgtaaccattgctttttgcttgtactgggtctctctggttagaccagatctgagcctgggagctctctggctaactagggaacccactgcttaagcctcaataaagcttgcctcgaccagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcctgcagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttag

SEQ ID NO: 31 - DNA, 7183 bp, Artificial Sequence
  pCVL_T7_DmrA-TM-41BB-CD3z lentiviral vector
aaaaataaacaaataggggttccgcgcacatttccccgaaaagtgccacctgacgtcaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaatgaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcggttaacttttaaaagaaaaggggggattggggggtacagtgcaggggaaagaatagtagacataatagcaacagacatacaaactaaagaattacaaaaacaaattacaaaaattcaaaattttatcgattacgcgtaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacacctgcaggtaatacgactcactatagggtccactgccgccaccatggctctgcctgtgacagctctgctgctgcctctggccctgctgctccatgccgccagacccggatccggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaagctagcgccaagcctaccaccacccctgcccctagacctccaacacccgccccaacaatcgccagccagcctctgtctctgaggcccgaggcttgtagaccagctgctggcggagccgtgcacaccagaggactggatttcgcctgcgacatctacatctgggcccctctggccggcacatgtggcgtgctgctgctgagcctcgtgatcaccatgcataaacggggcagaaagaaactcctgtatatattcaaacaaccatttatgagaccagtacaaactactcaagaggaagatggctgtagctgccgatttccagaagaagaagaaggaggatgtgaactgcgggtgaagttcagcagaagcgccgacgcccctgcctaccagcagggccagaatcagctgtacaacgagctgaacctgggcagaagggaagagtacgacgtcctggataagcggagaggccgggaccctgagatgggcggcaagcctcggcggaagaacccccaggaaggcctgtataacgaactgcagaaagacaagatggccgaggcctacagcgagatcggcatgaagggcgagcggaggcggggcaagggccacgacggcctgtatcagggcctgtccaccgccaccaaggatacctacgacgccctgcacatgcaggccctgcccccaaggggcggccgctccggtgagggcagaggaagtcttctaacatgcggtgacgtggaggagaatccgggcccctctagaagcgagctgattaaggagaacatgcacatgaagctgtacatggagggcaccgtggacaaccatcacttcaagtgcacatccgagggcgaaggcaagccctacgagggcacccagaccatgagaatcaaggtggtcgagggcggccctctccccttcgccttcgacatcctggctactagcttcctctacggcagcaagaccttcatcaaccacacccagggcatccccgacttcttcaagcagtccttccctgagggcttcacatgggagagagtcaccacatacgaagacgggggcgtgctgaccgctacccaggacaccagcctccaggacggctgcctcatctacaacgtcaagatcagaggggtgaacttcacatccaacggccctgtgatgcagaagaaaacactcggctgggaggccttcaccgagacgctgtaccccgctgacggcggcctggaaggcagaaacgacatggccctgaagctcgtgggcgggagccatctgatcgcaaacatcaagaccacatatagatccaagaaacccgctaagaacctcaagatgcctggcgtctactatgtggactacagactggaaagaatcaaggaggccaacaacgagacctacgtcgagcagcacgaggtggcagtggccagatactgcgacctccctagcaaactggggcacaagcttaattgagtcgaccgagcatcttaccgccatttatacccatatttgttctgtttttcttgatttgggtatacatttaaatgttaatagaacaaaatggtggggcaatcatttacatttttagggatatgtaattactagttcaggtgtattgccacaagacaaacatgttaagaaactttcccgttatttacgctctgttcctgttaatcaacctctggattacaaaatttgtgaaagattgactgatattcttaactatgttgctccttttacgctgtgtggatatgctgctttatagcctctgtatctagctattgcttcccgtacggctttcgttttctcctccttgtataaatcctggttgctgtctcttttagaggagttgtggcccgttgtccgtcaacgtggcgtggtgtgctctgtgtttgctgacgcaacccccactggctggggcattgccaccacctgtcaactcctttctgggactttcgctttccccctcccgatcgccacggcagaactcatcgccgcctgccttgcccgctgctggacaggggctaggttgctgggcactgataattccgtggtgttgtcatcgaattcggtacctttttaaaagaaaaggggggactggaagggctaattcactcccaacgaagacaagatatcataacttcgtatagcatacattatacgaagttataatttatttgtgaaatttgtgatgctattgctttatttgtaaccatatgtttatttgtgaaatttgtgatgctattgctttatttgtaaccattgctttttgcttgtactgggtctctctggttagaccagatctgagcctgggagctctctggctaactagggaacccactgcttaagcctcaataaagcttgcctcgaccagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcctgcagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttag

SEQ ID NO: 32 - DNA, 7663 bp, Artificial Sequence
  pCVL_T7_DmrA-spacer-TM-41BB-CD3z lentiviral vector
aaaaataaacaaataggggttccgcgcacatttccccgaaaagtgccacctgacgtcaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaatgaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcggttaacttttaaaagaaaaggggggattggggggtacagtgcaggggaaagaatagtagacataatagcaacagacatacaaactaaagaattacaaaaacaaattacaaaaattcaaaattttatcgattacgcgtaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacacctgcaggtaatacgactcactatagggtccactgccgccaccatggctctgcctgtgacagctctgctgctgcctctggccctgctgctccatgccgccagacccggatccggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaagctagcgagagcaagtacggaccgccctgcccaccttgccctgcccccgagttcctgggcggacccagcgtgttcctgttcccacccaagcccaaggacaccctgatgatcagccggacccccgaggtgacctgcgtggtggtggacgtgagccaggaagatcccgaggtccagttcaattggtacgtggacggcgtggaagtgcacaacgccaagaccaagcccagagaggaacagttcaacagcacctaccgggtggtgtctgtgctgaccgtgctgcaccaggactggctgaacggcaaagaatacaagtgcaaggtgtccaacaagggcctgcccagcagcatcgaaaagaccatcagcaaggccaagggccagcctcgcgagccccaggtgtacaccctgcctccctcccaggaagagatgaccaagaaccaggtgtccctgacctgcctggtgaagggcttctaccccagcgacatcgccgtggagtgggagagcaacggccagcctgagaacaactacaagaccacccctcccgtgctggacagcgacggcagcttcttcctgtacagccggctgaccgtggacaagagccggtggcaggaaggcaacgtctttagctgcagcgtgatgcacgaggccctgcacaaccactacacccagaagagcctgagcctgtccctgggcaagatgcataaacggggcagaaagaaactcctgtatatattcaaacaaccatttatgagaccagtacaaactactcaagaggaagatggctgtagctgccgatttccagaagaagaagaaggaggatgtgaactgcgggtgaagttcagcagaagcgccgacgcccctgcctaccagcagggccagaatcagctgtacaacgagctgaacctgggcagaagggaagagtacgacgtcctggataagcggagaggccgggaccctgagatgggcggcaagcctcggcggaagaacccccaggaaggcctgtataacgaactgcagaaagacaagatggccgaggcctacagcgagatcggcatgaagggcgagcggaggcggggcaagggccacgacggcctgtatcagggcctgtccaccgccaccaaggatacctacgacgccctgcacatgcaggccctgcccccaaggggcggccgctccggtgagggcagaggaagtcttctaacatgcggtgacgtggaggagaatccgggcccctctagaagcgagctgattaaggagaacatgcacatgaagctgtacatggagggcaccgtggacaaccatcacttcaagtgcacatccgagggcgaaggcaagccctacgagggcacccagaccatgagaatcaaggtggtcgagggcggccctctccccttcgccttcgacatcctggctactagcttcctctacggcagcaagaccttcatcaaccacacccagggcatccccgacttcttcaagcagtccttccctgagggcttcacatgggagagagtcaccacatacgaagacgggggcgtgctgaccgctacccaggacaccagcctccaggacggctgcctcatctacaacgtcaagatcagaggggtgaacttcacatccaacggccctgtgatgcagaagaaaacactcggctgggaggccttcaccgagacgctgtaccccgctgacggcggcctggaaggcagaaacgacatggccctgaagctcgtgggcgggagccatctgatcgcaaacatcaagaccacatatagatccaagaaacccgctaagaacctcaagatgcctggcgtctactatgtggactacagactggaaagaatcaaggaggccaacaacgagacctacgtcgagcagcacgaggtggcagtggccagatactgcgacctccctagcaaactggggcacaagcttaattgagtcgaccgagcatcttaccgccatttatacccatatttgttctgtttttcttgatttgggtatacatttaaatgttaatagaacaaaatggtggggcaatcatttacatttttagggatatgtaattactagttcaggtgtattgccacaagacaaacatgttaagaaactttcccgttatttacgctctgttcctgttaatcaacctctggattacaaaatttgtgaaagattgactgatattcttaactatgttgctccttttacgctgtgtggatatgctgctttatagcctctgtatctagctattgcttcccgtacggctttcgttttctcctccttgtataaatcctggttgctgtctcttttagaggagttgtggcccgttgtccgtcaacgtggcgtggtgtgctctgtgtttgctgacgcaacccccactggctggggcattgccaccacctgtcaactcctttctgggactttcgctttccccctcccgatcgccacggcagaactcatcgccgcctgccttgcccgctgctggacaggggctaggttgctgggcactgataattccgtggtgttgtcatcgaattcggtacctttttaaaagaaaaggggggactggaagggctaattcactcccaacgaagacaagatatcataacttcgtatagcatacattatacgaagttataatttatttgtgaaatttgtgatgctattgctttatttgtaaccatatgtttatttgtgaaatttgtgatgctattgctttatttgtaaccattgctttttgcttgtactgggtctctctggttagaccagatctgagcctgggagctctctggctaactagggaacccactgcttaagcctcaataaagcttgcctcgaccagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcctgcagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttag

SEQ ID NO: 33 - DNA, 7477 bp, Artificial Sequence
  pCVL_T7_DmrB-DmrC-TM-41BB-CD3z lentiviral vector
aaaaataaacaaataggggttccgcgcacatttccccgaaaagtgccacctgacgtcaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaatgaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcggttaacttttaaaagaaaaggggggattggggggtacagtgcaggggaaagaatagtagacataatagcaacagacatacaaactaaagaattacaaaaacaaattacaaaaattcaaaattttatcgattacgcgtaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacacctgcaggtaatacgactcactatagggtccactgccgccaccatggctctgcctgtgacagctctgctgctgcctctggccctgctgctccatgccgccagacccggatccggagtgcaggtggaaaccatctccccaggagacgggcgcaccttccccaagcgcggccagacctgcgtggtgcactacaccgggatgcttgaagatggaaagaaagttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaaggcggaggtgggagcatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcctccaagcctgggacctctattatcatgtgttccgacgaatctcaaaggctagcgccaagcctaccaccacccctgcccctagacctccaacacccgccccaacaatcgccagccagcctctgtctctgaggcccgaggcttgtagaccagctgctggcggagccgtgcacaccagaggactggatttcgcctgcgacatctacatctgggcccctctggccggcacatgtggcgtgctgctgctgagcctcgtgatcaccatgcataaacggggcagaaagaaactcctgtatatattcaaacaaccatttatgagaccagtacaaactactcaagaggaagatggctgtagctgccgatttccagaagaagaagaaggaggatgtgaactgcgggtgaagttcagcagaagcgccgacgcccctgcctaccagcagggccagaatcagctgtacaacgagctgaacctgggcagaagggaagagtacgacgtcctggataagcggagaggccgggaccctgagatgggcggcaagcctcggcggaagaacccccaggaaggcctgtataacgaactgcagaaagacaagatggccgaggcctacagcgagatcggcatgaagggcgagcggaggcggggcaagggccacgacggcctgtatcagggcctgtccaccgccaccaaggatacctacgacgccctgcacatgcaggccctgcccccaaggggcggccgctccggtgagggcagaggaagtcttctaacatgcggtgacgtggaggagaatccgggcccctctagaagcgagctgattaaggagaacatgcacatgaagctgtacatggagggcaccgtggacaaccatcacttcaagtgcacatccgagggcgaaggcaagccctacgagggcacccagaccatgagaatcaaggtggtcgagggcggccctctccccttcgccttcgacatcctggctactagcttcctctacggcagcaagaccttcatcaaccacacccagggcatccccgacttcttcaagcagtccttccctgagggcttcacatgggagagagtcaccacatacgaagacgggggcgtgctgaccgctacccaggacaccagcctccaggacggctgcctcatctacaacgtcaagatcagaggggtgaacttcacatccaacggccctgtgatgcagaagaaaacactcggctgggaggccttcaccgagacgctgtaccccgctgacggcggcctggaaggcagaaacgacatggccctgaagctcgtgggcgggagccatctgatcgcaaacatcaagaccacatatagatccaagaaacccgctaagaacctcaagatgcctggcgtctactatgtggactacagactggaaagaatcaaggaggccaacaacgagacctacgtcgagcagcacgaggtggcagtggccagatactgcgacctccctagcaaactggggcacaagcttaattgagtcgaccgagcatcttaccgccatttatacccatatttgttctgtttttcttgatttgggtatacatttaaatgttaatagaacaaaatggtggggcaatcatttacatttttagggatatgtaattactagttcaggtgtattgccacaagacaaacatgttaagaaactttcccgttatttacgctctgttcctgttaatcaacctctggattacaaaatttgtgaaagattgactgatattcttaactatgttgctccttttacgctgtgtggatatgctgctttatagcctctgtatctagctattgcttcccgtacggctttcgttttctcctccttgtataaatcctggttgctgtctcttttagaggagttgtggcccgttgtccgtcaacgtggcgtggtgtgctctgtgtttgctgacgcaacccccactggctggggcattgccaccacctgtcaactcctttctgggactttcgctttccccctcccgatcgccacggcagaactcatcgccgcctgccttgcccgctgctggacaggggctaggttgctgggcactgataattccgtggtgttgtcatcgaattcggtacctttttaaaagaaaaggggggactggaagggctaattcactcccaacgaagacaagatatcataacttcgtatagcatacattatacgaagttataatttatttgtgaaatttgtgatgctattgctttatttgtaaccatatgtttatttgtgaaatttgtgatgctattgctttatttgtaaccattgctttttgcttgtactgggtctctctggttagaccagatctgagcctgggagctctctggctaactagggaacccactgcttaagcctcaataaagcttgcctcgaccagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcctgcagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttag

SEQ ID NO: 34 - DNA, 7519 bp, Artificial Sequence
  pCVL_T7_DmrB-DmrA-TM-41BB-CD3z lentiviral vector
aaaaataaacaaataggggttccgcgcacatttccccgaaaagtgccacctgacgtcaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaatgaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcggttaacttttaaaagaaaaggggggattggggggtacagtgcaggggaaagaatagtagacataatagcaacagacatacaaactaaagaattacaaaaacaaattacaaaaattcaaaattttatcgattacgcgtaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacacctgcaggtaatacgactcactatagggtccactgccgccaccatggctctgcctgtgacagctctgctgctgcctctggccctgctgctccatgccgccagacccggatccggagtgcaggtggaaaccatctccccaggagacgggcgcaccttccccaagcgcggccagacctgcgtggtgcactacaccgggatgcttgaagatggaaagaaagttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaaggcggaggtgggagcggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaagctagcgccaagcctaccaccacccctgcccctagacctccaacacccgccccaacaatcgccagccagcctctgtctctgaggcccgaggcttgtagaccagctgctggcggagccgtgcacaccagaggactggatttcgcctgcgacatctacatctgggcccctctggccggcacatgtggcgtgctgctgctgagcctcgtgatcaccatgcataaacggggcagaaagaaactcctgtatatattcaaacaaccatttatgagaccagtacaaactactcaagaggaagatggctgtagctgccgatttccagaagaagaagaaggaggatgtgaactgcgggtgaagttcagcagaagcgccgacgcccctgcctaccagcagggccagaatcagctgtacaacgagctgaacctgggcagaagggaagagtacgacgtcctggataagcggagaggccgggaccctgagatgggcggcaagcctcggcggaagaacccccaggaaggcctgtataacgaactgcagaaagacaagatggccgaggcctacagcgagatcggcatgaagggcgagcggaggcggggcaagggccacgacggcctgtatcagggcctgtccaccgccaccaaggatacctacgacgccctgcacatgcaggccctgcccccaaggggcggccgctccggtgagggcagaggaagtcttctaacatgcggtgacgtggaggagaatccgggcccctctagaagcgagctgattaaggagaacatgcacatgaagctgtacatggagggcaccgtggacaaccatcacttcaagtgcacatccgagggcgaaggcaagccctacgagggcacccagaccatgagaatcaaggtggtcgagggcggccctctccccttcgccttcgacatcctggctactagcttcctctacggcagcaagaccttcatcaaccacacccagggcatccccgacttcttcaagcagtccttccctgagggcttcacatgggagagagtcaccacatacgaagacgggggcgtgctgaccgctacccaggacaccagcctccaggacggctgcctcatctacaacgtcaagatcagaggggtgaacttcacatccaacggccctgtgatgcagaagaaaacactcggctgggaggccttcaccgagacgctgtaccccgctgacggcggcctggaaggcagaaacgacatggccctgaagctcgtgggcgggagccatctgatcgcaaacatcaagaccacatatagatccaagaaacccgctaagaacctcaagatgcctggcgtctactatgtggactacagactggaaagaatcaaggaggccaacaacgagacctacgtcgagcagcacgaggtggcagtggccagatactgcgacctccctagcaaactggggcacaagcttaattgagtcgaccgagcatcttaccgccatttatacccatatttgttctgtttttcttgatttgggtatacatttaaatgttaatagaacaaaatggtggggcaatcatttacatttttagggatatgtaattactagttcaggtgtattgccacaagacaaacatgttaagaaactttcccgttatttacgctctgttcctgttaatcaacctctggattacaaaatttgtgaaagattgactgatattcttaactatgttgctccttttacgctgtgtggatatgctgctttatagcctctgtatctagctattgcttcccgtacggctttcgttttctcctccttgtataaatcctggttgctgtctcttttagaggagttgtggcccgttgtccgtcaacgtggcgtggtgtgctctgtgtttgctgacgcaacccccactggctggggcattgccaccacctgtcaactcctttctgggactttcgctttccccctcccgatcgccacggcagaactcatcgccgcctgccttgcccgctgctggacaggggctaggttgctgggcactgataattccgtggtgttgtcatcgaattcggtacctttttaaaagaaaaggggggactggaagggctaattcactcccaacgaagacaagatatcataacttcgtatagcatacattatacgaagttataatttatttgtgaaatttgtgatgctattgctttatttgtaaccatatgtttatttgtgaaatttgtgatgctattgctttatttgtaaccattgctttttgcttgtactgggtctctctggttagaccagatctgagcctgggagctctctggctaactagggaacccactgcttaagcctcaataaagcttgcctcgaccagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcctgcagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttag

SEQ ID NO: 35 - DNA, 7672 bp, Artificial Sequence
  pCVL_sEF1a_CD19-Puro lentiviral vector
aaaaataaacaaataggggttccgcgcacatttccccgaaaagtgccacctgacgtcaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaatgaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcggttaacttttaaaagaaaaggggggattggggggtacagtgcaggggaaagaatagtagacataatagcaacagacatacaaactaaagaattacaaaaacaaattacaaaaattcaaaattttatcgattacgcgtaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacacctgcagggccgccaccatgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctgggattacctgggttaggcatccacatgaggcccctggccatctggcttttcatcttcaacgtctctcaacagatgggaggcttctacctgtgccagccggggcctccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccagtactatggcactggctgctgaggactggtggctggaaggtctcagctgtgactttggcttatctgatcttctgcctgtgttcccttgtgggcattcttcatcttcaaagagccctggtcctgaggaggaagaggaagcgtatgactgaccccaccaggagatttttcaaagtgacgcctcccccaggaagcgggccccagaaccagtacgggaacgtgctgtctctccccacacccacctcaggcctcggacgcgcccagcgttgggccgcaggcctgggaggcactgccccgtcttatggaaacccgagcagcgacgtccaggcggatggagccttggggtcccggagcccgccgggagtgggcccagaagaagaggaaggggagggctacgaggaacctgacagtgaggaggactccgagttctatgagaacgactccaaccttgggcaggaccagctctcccaggatggcagcggctacgagaaccctgaggatgagcccctgggtcctgaggacgaggactccttctccaacgctgagagctatgaaaatgaagatgaggagctcacacaacccgtcgccaggacaatggacttcctgagccctcatgggtcagcatgggatccgagccgggaagcaacctccctggcagggtcccagtcctatgaggatatgagaggaatcctgtatgcagcccctcagctccgctccattcggggccagcctggacccaatcatgaggaagatgcagactcttatgagaacatggataatcccgatgggccagacccagcctggggaggagggggccgcatgggcacctggagcactcgcggcggccgctccggtgagggcagaggaagtcttctaacatgcggtgacgtggaggagaatccgggcccctctagaaccgagtacaagcccacggtgcgcctcgccacccgcgacgacgtcccccgggccgtacgcaccctcgccgccgcgttcgccgactaccccgccacgcgccacaccgtcgatcccgaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgccctcgagtgatgagagtcatcgtcgaccgagcatcttaccgccatttatacccatatttgttctgtttttcttgatttgggtatacatttaaatgttaatagaacaaaatggtggggcaatcatttacatttttagggatatgtaattactagttcaggtgtattgccacaagacaaacatgttaagaaactttcccgttatttacgctctgttcctgttaatcaacctctggattacaaaatttgtgaaagattgactgatattcttaactatgttgctccttttacgctgtgtggatatgctgctttatagcctctgtatctagctattgcttcccgtacggctttcgttttctcctccttgtataaatcctggttgctgtctcttttagaggagttgtggcccgttgtccgtcaacgtggcgtggtgtgctctgtgtttgctgacgcaacccccactggctggggcattgccaccacctgtcaactcctttctgggactttcgctttccccctcccgatcgccacggcagaactcatcgccgcctgccttgcccgctgctggacaggggctaggttgctgggcactgataattccgtggtgttgtcatcgaattcggtacctttttaaaagaaaaggggggactggaagggctaattcactcccaacgaagacaagatatcataacttcgtatagcatacattatacgaagttataatttatttgtgaaatttgtgatgctattgctttatttgtaaccatatgtttatttgtgaaatttgtgatgctattgctttatttgtaaccattgctttttgcttgtactgggtctctctggttagaccagatctgagcctgggagctctctggctaactagggaacccactgcttaagcctcaataaagcttgcctcgaccagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcctgcagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttag

SEQ ID NO: 36 - DNA, 6892 bp, Artificial Sequence
  pCVL_sEF1a_CD20-Puro lentiviral vector
aaaaataaacaaataggggttccgcgcacatttccccgaaaagtgccacctgacgtcaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaatgaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcggttaacttttaaaagaaaaggggggattggggggtacagtgcaggggaaagaatagtagacataatagcaacagacatacaaactaaagaattacaaaaacaaattacaaaaattcaaaattttatcgattacgcgtaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacacctgcagggccgccaccatgacaacacccagaaattcagtaaatgggactttcccggcagagccaatgaaaggccctattgctatgcaatctggtccaaaaccactcttcaggaggatgtcttcactggtgggccccacgcaaagcttcttcatgagggaatctaagactttgggggctgtccagattatgaatgggctcttccacattgccctgggaggtcttctgatgatcccagcagggatctatgcacccatctgtgtgactgtgtggtaccctctctggggaggcattatgtatattatttccggatcactcctggcagcaacggagaaaaactccaggaagtgtttggtcaaaggaaaaatgataatgaattcattgagcctctttgctgccatttctggaatgattctttcaatcatggacatacttaatattaaaatttcccattttttaaaaatggagagtctgaattttattagagctcacacaccatatattaacatatacaactgtgaaccagctaatccctctgagaaaaactccccatctacccaatactgttacagcatacaatctctgttcttgggcattttgtcagtgatgctgatctttgccttcttccaggaacttgtaatagctggcatcgttgagaatgaatggaaaagaacgtgctccagacccaaatctaacatagttctcctgtcagcagaagaaaaaaaagaacagactattgaaataaaagaagaagtggttgggctaactgaaacatcttcccaaccaaagaatgaagaagacattgaaattattccaatccaagaagaggaagaagaagaaacagagacgaactttccagaacctccccaagatcaggaatcctcaccaatagaaaatgacagctctcctggcggccgctccggtgagggcagaggaagtcttctaacatgcggtgacgtggaggagaatccgggcccctctagaaccgagtacaagcccacggtgcgcctcgccacccgcgacgacgtcccccgggccgtacgcaccctcgccgccgcgttcgccgactaccccgccacgcgccacaccgtcgatcccgaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgccctcgagtgatgagagtcatcgtcgaccgagcatcttaccgccatttatacccatatttgttctgtttttcttgatttgggtatacatttaaatgttaatagaacaaaatggtggggcaatcatttacatttttagggatatgtaattactagttcaggtgtattgccacaagacaaacatgttaagaaactttcccgttatttacgctctgttcctgttaatcaacctctggattacaaaatttgtgaaagattgactgatattcttaactatgttgctccttttacgctgtgtggatatgctgctttatagcctctgtatctagctattgcttcccgtacggctttcgttttctcctccttgtataaatcctggttgctgtctcttttagaggagttgtggcccgttgtccgtcaacgtggcgtggtgtgctctgtgtttgctgacgcaacccccactggctggggcattgccaccacctgtcaactcctttctgggactttcgctttccccctcccgatcgccacggcagaactcatcgccgcctgccttgcccgctgctggacaggggctaggttgctgggcactgataattccgtggtgttgtcatcgaattcggtacctttttaaaagaaaaggggggactggaagggctaattcactcccaacgaagacaagatatcataacttcgtatagcatacattatacgaagttataatttatttgtgaaatttgtgatgctattgctttatttgtaaccatatgtttatttgtgaaatttgtgatgctattgctttatttgtaaccattgctttttgcttgtactgggtctctctggttagaccagatctgagcctgggagctctctggctaactagggaacccactgcttaagcctcaataaagcttgcctcgaccagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcctgcagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttag

SEQ ID NO: 37 - protein, 570 aa, Artificial Sequence
  SS-2xDmrB-DmrC-TM-41BB-CD3z protein
MALPVTALLLPLALLLHAARPGSGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVEFLKLESGTSGTSGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEGSRSILWHEMWHEGLEEASRLYFGERNVKGMFEVLEPLHAMMERGPQTLKETSFNQAYGRDLMEAQEWCRKYMKSGNVKDLLQAWDLYYHVFRRISKASAKPTTTPAPRPPTPAPTIASQPLSLRPEACRPAAGGAVHTRGLDFACDIYIWAPLAGTCGVLLLSLVITMHKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRG

SEQ ID NO: 38 - RNA, 1710 nt, Artificial Sequence
  SS-2xDmrB-DmrC-TM-41BB-CD3z mRNA
auggcucugccugugacagcucugcugcugccucuggcccugcugcuccaugccgccagacccggauccggcgguguccaagucgaaacuauaucgccuggcgauggcagaacguuucccaaacguggccagaccugugucguacacuauaccggcaugcuagaggaugggaaaaagguugauuccagucgcgaucggaacaaaccguuuaaauucauguuggggaagcaagagguuaucaggggaugggaagagggugucgcgcaaaugucgguugggcaacgugcgaaacucacaauuuccccggauuacgcauacggagcuaccggacacccugggauuaucccaccgcaugcgacgcuaguguuugacguagaguucuugaagcucgaaucagguacaagcggcacuucuggcguacagguugagacaauuagucccggagacggacguacauucccaaagagagggcaaacuugcguaguccauuacacuggaauguuggaagacggcaagaaaguggacaguucaagagaccgcaauaagccuuucaaguuuaugcucggaaaacaggaagucauacgcgguugggaggaaggcguggcucagaugagcgucggacagagggcaaaguugaccaucagucccgacuaugcguauggcgcgacaggccaucccggaaucauaccuccccacgcaaccuugguauucgaugucgaacugcucaaauuagaggguaguagauccauccucuggcaugagauguggcaugaaggccuggaagaggcaucucguuuguacuuuggggaaaggaacgugaaaggcauguuugaggugcuggagcccuugcaugcuaugauggaacggggcccccagacucugaaggaaacauccuuuaaucaggccuauggucgagauuuaauggaggcccaagaguggugcaggaaguacaugaaaucagggaaugucaaggaccuccuccaagccugggaccucuauuaucauguguuccgacgaaucucaaaggcuagcgccaagccuaccaccaccccugccccuagaccuccaacacccgccccaacaaucgccagccagccucugucucugaggcccgaggcuuguagaccagcugcuggcggagccguacacaccagaggacuggauuucgccugcgacaucuacaucugggccccucuggccggcacauguggcgugcugcugcugagccucgugaucaccaugcauaaacggggcagaaagaaacuccuguauauauucaaacaaccauuuaugagaccaguacaaacuacucaagaggaagauggcuguagcugccgauuuccagaagaagaagaaggaggaugugaacugcgggugaaguucagcagaagcgccgacgccccugccuaccagcagggccagaaucagcuguacaacgagcugaaccugggcagaagggaagaguacgacguccuggauaagcggagaggccgggacccugagaugggcggcaagccucggcggaagaacccccaggaaggccuguauaacgaacugcagaaagacaagauggccgaggccuacagcgagaucggcaugaagggcgagcggaggcggggcaagggccacgacggccuguaucagggccuguccaccgccaccaaggauaccuacgacgcccugcacaugcaggcccugcccccaaggggc

SEQ ID NO: 39 - DNA, 1710 bp, Artificial Sequence
  SS-2xDmrB-DmrC-TM-41BB-CD3z DNA
atggctctgcctgtgacagctctgctgctgcctctggccctgctgctccatgccgccagacccggatccggcggtgtccaagtcgaaactatatcgcctggcgatggcagaacgtttcccaaacgtggccagacctgtgtcgtacactataccggcatgctagaggatgggaaaaaggttgattccagtcgcgatcggaacaaaccgtttaaattcatgttggggaagcaagaggttatcaggggatgggaagagggtgtcgcgcaaatgtcggttgggcaacgtgcgaaactcacaatttccccggattacgcatacggagctaccggacaccctgggattatcccaccgcatgcgacgctagtgtttgacgtagagttcttgaagctcgaatcaggtacaagcggcacttctggcgtacaggttgagacaattagtcccggagacggacgtacattcccaaagagagggcaaacttgcgtagtccattacactggaatgttggaagacggcaagaaagtggacagttcaagagaccgcaataagcctttcaagtttatgctcggaaaacaggaagtcatacgcggttgggaggaaggcgtggctcagatgagcgtcggacagagggcaaagttgaccatcagtcccgactatgcgtatggcgcgacaggccatcccggaatcatacctccccacgcaaccttggtattcgatgtcgaactgctcaaattagagggtagtagatccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcctccaagcctgggacctctattatcatgtgttccgacgaatctcaaaggctagcgccaagcctaccaccacccctgcccctagacctccaacacccgccccaacaatcgccagccagcctctgtctctgaggcccgaggcttgtagaccagctgctggcggagccgtacacaccagaggactggatttcgcctgcgacatctacatctgggcccctctggccggcacatgtggcgtgctgctgctgagcctcgtgatcaccatgcataaacggggcagaaagaaactcctgtatatattcaaacaaccatttatgagaccagtacaaactactcaagaggaagatggctgtagctgccgatttccagaagaagaagaaggaggatgtgaactgcgggtgaagttcagcagaagcgccgacgcccctgcctaccagcagggccagaatcagctgtacaacgagctgaacctgggcagaagggaagagtacgacgtcctggataagcggagaggccgggaccctgagatgggcggcaagcctcggcggaagaacccccaggaaggcctgtataacgaactgcagaaagacaagatggccgaggcctacagcgagatcggcatgaagggcgagcggaggcggggcaagggccacgacggcctgtatcagggcctgtccaccgccaccaaggatacctacgacgccctgcacatgcaggccctgcccccaaggggc

SEQ ID NO: 40 - DNA, 7819 bp, Artificial Sequence
  pCVL_sEF1a_T7_2xDmrB-DmrC-TM-41BB-CD3z lentiviral vector
aaaaataaacaaataggggttccgcgcacatttccccgaaaagtgccacctgacgtcaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaatgaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcggttaacttttaaaagaaaaggggggattggggggtacagtgcaggggaaagaatagtagacataatagcaacagacatacaaactaaagaattacaaaaacaaattacaaaaattcaaaattttatcgattacgcgtaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacacctgcaggtaatacgactcactatagggtccactgccgccaccatggctctgcctgtgacagctctgctgctgcctctggccctgctgctccatgccgccagacccggatccggcggtgtccaagtcgaaactatatcgcctggcgatggcagaacgtttcccaaacgtggccagacctgtgtcgtacactataccggcatgctagaggatgggaaaaaggttgattccagtcgcgatcggaacaaaccgtttaaattcatgttggggaagcaagaggttatcaggggatgggaagagggtgtcgcgcaaatgtcggttgggcaacgtgcgaaactcacaatttccccggattacgcatacggagctaccggacaccctgggattatcccaccgcatgcgacgctagtgtttgacgtagagttcttgaagctcgaatcaggtacaagcggcacttctggcgtacaggttgagacaattagtcccggagacggacgtacattcccaaagagagggcaaacttgcgtagtccattacactggaatgttggaagacggcaagaaagtggacagttcaagagaccgcaataagcctttcaagtttatgctcggaaaacaggaagtcatacgcggttgggaggaaggcgtggctcagatgagcgtcggacagagggcaaagttgaccatcagtcccgactatgcgtatggcgcgacaggccatcccggaatcatacctccccacgcaaccttggtattcgatgtcgaactgctcaaattagagggtagtagatccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcctccaagcctgggacctctattatcatgtgttccgacgaatctcaaaggctagcgccaagcctaccaccacccctgcccctagacctccaacacccgccccaacaatcgccagccagcctctgtctctgaggcccgaggcttgtagaccagctgctggcggagccgtacacaccagaggactggatttcgcctgcgacatctacatctgggcccctctggccggcacatgtggcgtgctgctgctgagcctcgtgatcaccatgcataaacggggcagaaagaaactcctgtatatattcaaacaaccatttatgagaccagtacaaactactcaagaggaagatggctgtagctgccgatttccagaagaagaagaaggaggatgtgaactgcgggtgaagttcagcagaagcgccgacgcccctgcctaccagcagggccagaatcagctgtacaacgagctgaacctgggcagaagggaagagtacgacgtcctggataagcggagaggccgggaccctgagatgggcggcaagcctcggcggaagaacccccaggaaggcctgtataacgaactgcagaaagacaagatggccgaggcctacagcgagatcggcatgaagggcgagcggaggcggggcaagggccacgacggcctgtatcagggcctgtccaccgccaccaaggatacctacgacgccctgcacatgcaggccctgcccccaaggggcggccgctccggtgagggcagaggaagtcttctaacatgcggtgacgtggaggagaatccgggcccctctagaagcgagctgattaaggagaacatgcacatgaagctgtacatggagggcaccgtggacaaccatcacttcaagtgcacatccgagggcgaaggcaagccctacgagggcacccagaccatgagaatcaaggtggtcgagggcggccctctccccttcgccttcgacatcctggctactagcttcctctacggcagcaagaccttcatcaaccacacccagggcatccccgacttcttcaagcagtccttccctgagggcttcacatgggagagagtcaccacatacgaagacgggggcgtgctgaccgctacccaggacaccagcctccaggacggctgcctcatctacaacgtcaagatcagaggggtgaacttcacatccaacggccctgtgatgcagaagaaaacactcggctgggaggccttcaccgagacgctgtaccccgctgacggcggcctggaaggcagaaacgacatggccctgaagctcgtgggcgggagccatctgatcgcaaacatcaagaccacatatagatccaagaaacccgctaagaacctcaagatgcctggcgtctactatgtggactacagactggaaagaatcaaggaggccaacaacgagacctacgtcgagcagcacgaggtggcagtggccagatactgcgacctccctagcaaactggggcacaagcttaattgagtcgaccgagcatcttaccgccatttatacccatatttgttctgtttttcttgatttgggtatacatttaaatgttaatagaacaaaatggtggggcaatcatttacatttttagggatatgtaattactagttcaggtgtattgccacaagacaaacatgttaagaaactttcccgttatttacgctctgttcctgttaatcaacctctggattacaaaatttgtgaaagattgactgatattcttaactatgttgctccttttacgctgtgtggatatgctgctttatagcctctgtatctagctattgcttcccgtacggctttcgttttctcctccttgtataaatcctggttgctgtctcttttagaggagttgtggcccgttgtccgtcaacgtggcgtggtgtgctctgtgtttgctgacgcaacccccactggctggggcattgccaccacctgtcaactcctttctgggactttcgctttccccctcccgatcgccacggcagaactcatcgccgcctgccttgcccgctgctggacaggggctaggttgctgggcactgataattccgtggtgttgtcatcgaattcggtacctttttaaaagaaaaggggggactggaagggctaattcactcccaacgaagacaagatatcataacttcgtatagcatacattatacgaagttataatttatttgtgaaatttgtgatgctattgctttatttgtaaccatatgtttatttgtgaaatttgtgatgctattgctttatttgtaaccattgctttttgcttgtactgggtctctctggttagaccagatctgagcctgggagctctctggctaactagggaacccactgcttaagcctcaataaagcttgcctcgaccagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcctgcagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttag

SEQ ID NO: 41 - protein, 741 aa, Artificial Sequence
  SS-scFvCD19-DmrA-fuP2A-DmrC-TM-41BB-CD3z protein
METDTLLLWVLLLWVPGSTGDYKDEGSDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSASGSGGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLEGGRARYKRSVSGSGATNFSLLKQAGDVEENPGPSRSILWHEMWHEGLEEASRLYFGERNVKGMFEVLEPLHAMMERGPQTLKETSFNQAYGRDLMEAQEWCRKYMKSGNVKDLLQAWDLYYHVFRRISKASAKPTTTPAPRPPTPAPTIASQPLSLRPEACRPAAGGAVHTRGLDFACDIYIWAPLAGTCGVLLLSLVITMHKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRG

SEQ ID NO: 42 - DNA, 2223 bp, Artificial Sequence
  SS-scFvCD19-DmrA-fuP2A-DmrC-TM-41BB-CD3z DNA
atggagacagacacactcctgctatgggtactgctgctctgggttccaggttccactggtgactacaaggacgagggatccgatatccagatgacccagaccaccagcagcctgagcgccagcctgggcgatagagtgaccatcagctgcagagccagccaggacatcagcaagtacctgaactggtatcagcagaaacccgacggcaccgtgaagctgctgatctaccacaccagcagactgcacagcggcgtgcccagcagattttctggcagcggctccggcaccgactacagcctgaccatctccaacctggaacaggaagatatcgctacctacttctgtcagcaaggcaacaccctgccctacaccttcggcggaggcaccaagctggaaatcaccggcagcacaagcggcagcggcaagcctggatctggcgagggaagcaccaagggcgaagtgaaactgcaggaaagcggccctggactggtggccccaagccagtctctgagcgtgacctgtaccgtgtccggcgtgtccctgcctgactatggcgtgtcctggatcagacagccacccagaaagggcctggaatggctgggagtgatctggggcagcgagacaacctactacaacagcgccctgaagtcccggctgaccatcatcaaggacaactccaagagccaggtgttcctgaagatgaacagcctgcagaccgacgacaccgccatctactactgcgccaagcactactactacggcggcagctacgccatggactactggggccagggcacaagcgtgaccgtgtccagcgctagcggctcaggaggagtgcaggttgaaaccatctccccaggagacgggcgcaccttcccgaagcgcggacagacatgcgtggtgcactacaccgggatgcttgaagatggaaagaaattcgattcatcgcgggacagaaacaagccctttaagtttatgctgggcaagcaggaggtcatccgaggctgggaagaaggggttgcccagatgagtgtcggccagagagccaaactgactatatcacctgactacgcctatggggccactgggcaccctggcataattccgccacacgccactctcgtcttcgatgtggagcttctaaaactggaaggcggccgcgctcgttacaagcgaagtgtctcaggatctggcgccacgaacttctctctgttaaagcaagcaggagatgttgaagaaaaccccgggccttcaagatccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcctccaagcctgggacctctattatcatgtgttccgacgaatctcaaaggctagcgccaagcctaccaccacccctgcccctagacctccaacacccgccccaacaatcgccagccagcctctgtctctgaggcccgaggcttgtagaccagctgctggcggagccgtacacaccagaggactggatttcgcctgcgacatctacatctgggcccctctggccggcacatgtggcgtgctgctgctgagcctcgtgatcaccatgcataaacggggcagaaagaaactcctgtatatattcaaacaaccatttatgagaccagtacaaactactcaagaggaagatggctgtagctgccgatttccagaagaagaagaaggaggatgtgaactgcgggtgaagttcagcagaagcgccgacgcccctgcctaccagcagggccagaatcagctgtacaacgagctgaacctgggcagaagggaagagtacgacgtcctggataagcggagaggccgggaccctgagatgggcggcaagcctcggcggaagaacccccaggaaggcctgtataacgaactgcagaaagacaagatggccgaggcctacagcgagatcggcatgaagggcgagcggaggcggggcaagggccacgacggcctgtatcagggcctgtccaccgccaccaaggatacctacgacgccctgcacatgcaggccctgcccccaaggggc

SEQ ID NO: 43 - DNA, 8306 bp, Artificial Sequence
  SS-scFvCD19-DmrA-fuP2A-DmrC-TM-41BB-CD3z lentiviral vector
aaaaataaacaaataggggttccgcgcacatttccccgaaaagtgccacctgacgtcaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaatgaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcggttaacttttaaaagaaaaggggggattggggggtacagtgcaggggaaagaatagtagacataatagcaacagacatacaaactaaagaattacaaaaacaaattacaaaaattcaaaattttatcgattacgcgtaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacacctgcagggccgccaccatggagacagacacactcctgctatgggtactgctgctctgggttccaggttccactggtgactacaaggacgagggatccgatatccagatgacccagaccaccagcagcctgagcgccagcctgggcgatagagtgaccatcagctgcagagccagccaggacatcagcaagtacctgaactggtatcagcagaaacccgacggcaccgtgaagctgctgatctaccacaccagcagactgcacagcggcgtgcccagcagattttctggcagcggctccggcaccgactacagcctgaccatctccaacctggaacaggaagatatcgctacctacttctgtcagcaaggcaacaccctgccctacaccttcggcggaggcaccaagctggaaatcaccggcagcacaagcggcagcggcaagcctggatctggcgagggaagcaccaagggcgaagtgaaactgcaggaaagcggccctggactggtggccccaagccagtctctgagcgtgacctgtaccgtgtccggcgtgtccctgcctgactatggcgtgtcctggatcagacagccacccagaaagggcctggaatggctgggagtgatctggggcagcgagacaacctactacaacagcgccctgaagtcccggctgaccatcatcaaggacaactccaagagccaggtgttcctgaagatgaacagcctgcagaccgacgacaccgccatctactactgcgccaagcactactactacggcggcagctacgccatggactactggggccagggcacaagcgtgaccgtgtccagcgctagcggctcaggaggagtgcaggttgaaaccatctccccaggagacgggcgcaccttcccgaagcgcggacagacatgcgtggtgcactacaccgggatgcttgaagatggaaagaaattcgattcatcgcgggacagaaacaagccctttaagtttatgctgggcaagcaggaggtcatccgaggctgggaagaaggggttgcccagatgagtgtcggccagagagccaaactgactatatcacctgactacgcctatggggccactgggcaccctggcataattccgccacacgccactctcgtcttcgatgtggagcttctaaaactggaaggcggccgcgctcgttacaagcgaagtgtctcaggatctggcgccacgaacttctctctgttaaagcaagcaggagatgttgaagaaaaccccgggccttcaagatccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcctccaagcctgggacctctattatcatgtgttccgacgaatctcaaaggctagcgccaagcctaccaccacccctgcccctagacctccaacacccgccccaacaatcgccagccagcctctgtctctgaggcccgaggcttgtagaccagctgctggcggagccgtacacaccagaggactggatttcgcctgcgacatctacatctgggcccctctggccggcacatgtggcgtgctgctgctgagcctcgtgatcaccatgcataaacggggcagaaagaaactcctgtatatattcaaacaaccatttatgagaccagtacaaactactcaagaggaagatggctgtagctgccgatttccagaagaagaagaaggaggatgtgaactgcgggtgaagttcagcagaagcgccgacgcccctgcctaccagcagggccagaatcagctgtacaacgagctgaacctgggcagaagggaagagtacgacgtcctggataagcggagaggccgggaccctgagatgggcggcaagcctcggcggaagaacccccaggaaggcctgtataacgaactgcagaaagacaagatggccgaggcctacagcgagatcggcatgaagggcgagcggaggcggggcaagggccacgacggcctgtatcagggcctgtccaccgccaccaaggatacctacgacgccctgcacatgcaggccctgcccccaaggggcggccgctccggtgagggcagaggaagtcttctaacatgcggtgacgtggaggagaatccgggcccctctagaagcgagctgattaaggagaacatgcacatgaagctgtacatggagggcaccgtggacaaccatcacttcaagtgcacatccgagggcgaaggcaagccctacgagggcacccagaccatgagaatcaaggtggtcgagggcggccctctccccttcgccttcgacatcctggctactagcttcctctacggcagcaagaccttcatcaaccacacccagggcatccccgacttcttcaagcagtccttccctgagggcttcacatgggagagagtcaccacatacgaagacgggggcgtgctgaccgctacccaggacaccagcctccaggacggctgcctcatctacaacgtcaagatcagaggggtgaacttcacatccaacggccctgtgatgcagaagaaaacactcggctgggaggccttcaccgagacgctgtaccccgctgacggcggcctggaaggcagaaacgacatggccctgaagctcgtgggcgggagccatctgatcgcaaacatcaagaccacatatagatccaagaaacccgctaagaacctcaagatgcctggcgtctactatgtggactacagactggaaagaatcaaggaggccaacaacgagacctacgtcgagcagcacgaggtggcagtggccagatactgcgacctccctagcaaactggggcacaagcttaattgagtcgaccgagcatcttaccgccatttatacccatatttgttctgtttttcttgatttgggtatacatttaaatgttaatagaacaaaatggtggggcaatcatttacatttttagggatatgtaattactagttcaggtgtattgccacaagacaaacatgttaagaaactttcccgttatttacgctctgttcctgttaatcaacctctggattacaaaatttgtgaaagattgactgatattcttaactatgttgctccttttacgctgtgtggatatgctgctttatagcctctgtatctagctattgcttcccgtacggctttcgttttctcctccttgtataaatcctggttgctgtctcttttagaggagttgtggcccgttgtccgtcaacgtggcgtggtgtgctctgtgtttgctgacgcaacccccactggctggggcattgccaccacctgtcaactcctttctgggactttcgctttccccctcccgatcgccacggcagaactcatcgccgcctgccttgcccgctgctggacaggggctaggttgctgggcactgataattccgtggtgttgtcatcgaattcggtacctttttaaaagaaaaggggggactggaagggctaattcactcccaacgaagacaagatatcataacttcgtatagcatacattatacgaagttataatttatttgtgaaatttgtgatgctattgctttatttgtaaccatatgtttatttgtgaaatttgtgatgctattgctttatttgtaaccattgctttttgcttgtactgggtctctctggttagaccagatctgagcctgggagctctctggctaactagggaacccactgcttaagcctcaataaagcttgcctcgaccagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcctgcagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttag

SEQ ID NO: 44 - protein, 741 aa, Artificial Sequence
  SS-scFvCD19-DmrA-fuP2A-FRB-TM-41BB-CD3z protein
METDTLLLWVLLLWVPGSTGDYKDEGSDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSASGSGGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLEGGRARYKRSVSGSGATNFSLLKQAGDVEENPGPSRSILWHEMWHEGLEEASRLYFGERNVKGMFEVLEPLHAMMERGPQTLKETSFNQAYGRDLMEAQEWCRKYMKSGNVKDLTQAWDLYYHVFRRISKASAKPTTTPAPRPPTPAPTIASQPLSLRPEACRPAAGGAVHTRGLDFACDIYIWAPLAGTCGVLLLSLVITMHKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRG

SEQ ID NO: 45 - DNA, 2223 bp, Artificial Sequence
  SS-scFvCD19-DmrA-fuP2A-FRB-TM-41BB-CD3z DNA
atggagacagacacactcctgctatgggtactgctgctctgggttccaggttccactggtgactacaaggacgagggatccgatatccagatgacccagaccaccagcagcctgagcgccagcctgggcgatagagtgaccatcagctgcagagccagccaggacatcagcaagtacctgaactggtatcagcagaaacccgacggcaccgtgaagctgctgatctaccacaccagcagactgcacagcggcgtgcccagcagattttctggcagcggctccggcaccgactacagcctgaccatctccaacctggaacaggaagatatcgctacctacttctgtcagcaaggcaacaccctgccctacaccttcggcggaggcaccaagctggaaatcaccggcagcacaagcggcagcggcaagcctggatctggcgagggaagcaccaagggcgaagtgaaactgcaggaaagcggccctggactggtggccccaagccagtctctgagcgtgacctgtaccgtgtccggcgtgtccctgcctgactatggcgtgtcctggatcagacagccacccagaaagggcctggaatggctgggagtgatctggggcagcgagacaacctactacaacagcgccctgaagtcccggctgaccatcatcaaggacaactccaagagccaggtgttcctgaagatgaacagcctgcagaccgacgacaccgccatctactactgcgccaagcactactactacggcggcagctacgccatggactactggggccagggcacaagcgtgaccgtgtccagcgctagcggctcaggaggagtgcaggttgaaaccatctccccaggagacgggcgcaccttcccgaagcgcggacagacatgcgtggtgcactacaccgggatgcttgaagatggaaagaaattcgattcatcgcgggacagaaacaagccctttaagtttatgctgggcaagcaggaggtcatccgaggctgggaagaaggggttgcccagatgagtgtcggccagagagccaaactgactatatcacctgactacgcctatggggccactgggcaccctggcataattccgccacacgccactctcgtcttcgatgtggagcttctaaaactggaaggcggccgcgctcgttacaagcgaagtgtctcaggatctggcgccacgaacttctctctgttaaagcaagcaggagatgttgaagaaaaccccgggccttcaagatccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcacccaagcctgggacctctattatcatgtgttccgacgaatctcaaaggctagcgccaagcctaccaccacccctgcccctagacctccaacacccgccccaacaatcgccagccagcctctgtctctgaggcccgaggcttgtagaccagctgctggcggagccgtacacaccagaggactggatttcgcctgcgacatctacatctgggcccctctggccggcacatgtggcgtgctgctgctgagcctcgtgatcaccatgcataaacggggcagaaagaaactcctgtatatattcaaacaaccatttatgagaccagtacaaactactcaagaggaagatggctgtagctgccgatttccagaagaagaagaaggaggatgtgaactgcgggtgaagttcagcagaagcgccgacgcccctgcctaccagcagggccagaatcagctgtacaacgagctgaacctgggcagaagggaagagtacgacgtcctggataagcggagaggccgggaccctgagatgggcggcaagcctcggcggaagaacccccaggaaggcctgtataacgaactgcagaaagacaagatggccgaggcctacagcgagatcggcatgaagggcgagcggaggcggggcaagggccacgacggcctgtatcagggcctgtccaccgccaccaaggatacctacgacgccctgcacatgcaggccctgcccccaaggggc

SEQ ID NO: 46 - DNA, 8306 bp, Artificial Sequence
  SS-scFvCD19-DmrA-fuP2A-FRB-TM-41BB-CD3z lentiviral vector
aaaaataaacaaataggggttccgcgcacatttccccgaaaagtgccacctgacgtcaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaatgaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcggttaacttttaaaagaaaaggggggattggggggtacagtgcaggggaaagaatagtagacataatagcaacagacatacaaactaaagaattacaaaaacaaattacaaaaattcaaaattttatcgattacgcgtaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacacctgcagggccgccaccatggagacagacacactcctgctatgggtactgctgctctgggttccaggttccactggtgactacaaggacgagggatccgatatccagatgacccagaccaccagcagcctgagcgccagcctgggcgatagagtgaccatcagctgcagagccagccaggacatcagcaagtacctgaactggtatcagcagaaacccgacggcaccgtgaagctgctgatctaccacaccagcagactgcacagcggcgtgcccagcagattttctggcagcggctccggcaccgactacagcctgaccatctccaacctggaacaggaagatatcgctacctacttctgtcagcaaggcaacaccctgccctacaccttcggcggaggcaccaagctggaaatcaccggcagcacaagcggcagcggcaagcctggatctggcgagggaagcaccaagggcgaagtgaaactgcaggaaagcggccctggactggtggccccaagccagtctctgagcgtgacctgtaccgtgtccggcgtgtccctgcctgactatggcgtgtcctggatcagacagccacccagaaagggcctggaatggctgggagtgatctggggcagcgagacaacctactacaacagcgccctgaagtcccggctgaccatcatcaaggacaactccaagagccaggtgttcctgaagatgaacagcctgcagaccgacgacaccgccatctactactgcgccaagcactactactacggcggcagctacgccatggactactggggccagggcacaagcgtgaccgtgtccagcgctagcggctcaggaggagtgcaggttgaaaccatctccccaggagacgggcgcaccttcccgaagcgcggacagacatgcgtggtgcactacaccgggatgcttgaagatggaaagaaattcgattcatcgcgggacagaaacaagccctttaagtttatgctgggcaagcaggaggtcatccgaggctgggaagaaggggttgcccagatgagtgtcggccagagagccaaactgactatatcacctgactacgcctatggggccactgggcaccctggcataattccgccacacgccactctcgtcttcgatgtggagcttctaaaactggaaggcggccgcgctcgttacaagcgaagtgtctcaggatctggcgccacgaacttctctctgttaaagcaagcaggagatgttgaagaaaaccccgggccttcaagatccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcacccaagcctgggacctctattatcatgtgttccgacgaatctcaaaggctagcgccaagcctaccaccacccctgcccctagacctccaacacccgccccaacaatcgccagccagcctctgtctctgaggcccgaggcttgtagaccagctgctggcggagccgtacacaccagaggactggatttcgcctgcgacatctacatctgggcccctctggccggcacatgtggcgtgctgctgctgagcctcgtgatcaccatgcataaacggggcagaaagaaactcctgtatatattcaaacaaccatttatgagaccagtacaaactactcaagaggaagatggctgtagctgccgatttccagaagaagaagaaggaggatgtgaactgcgggtgaagttcagcagaagcgccgacgcccctgcctaccagcagggccagaatcagctgtacaacgagctgaacctgggcagaagggaagagtacgacgtcctggataagcggagaggccgggaccctgagatgggcggcaagcctcggcggaagaacccccaggaaggcctgtataacgaactgcagaaagacaagatggccgaggcctacagcgagatcggcatgaagggcgagcggaggcggggcaagggccacgacggcctgtatcagggcctgtccaccgccaccaaggatacctacgacgccctgcacatgcaggccctgcccccaaggggcggccgctccggtgagggcagaggaagtcttctaacatgcggtgacgtggaggagaatccgggcccctctagaagcgagctgattaaggagaacatgcacatgaagctgtacatggagggcaccgtggacaaccatcacttcaagtgcacatccgagggcgaaggcaagccctacgagggcacccagaccatgagaatcaaggtggtcgagggcggccctctccccttcgccttcgacatcctggctactagcttcctctacggcagcaagaccttcatcaaccacacccagggcatccccgacttcttcaagcagtccttccctgagggcttcacatgggagagagtcaccacatacgaagacgggggcgtgctgaccgctacccaggacaccagcctccaggacggctgcctcatctacaacgtcaagatcagaggggtgaacttcacatccaacggccctgtgatgcagaagaaaacactcggctgggaggccttcaccgagacgctgtaccccgctgacggcggcctggaaggcagaaacgacatggccctgaagctcgtgggcgggagccatctgatcgcaaacatcaagaccacatatagatccaagaaacccgctaagaacctcaagatgcctggcgtctactatgtggactacagactggaaagaatcaaggaggccaacaacgagacctacgtcgagcagcacgaggtggcagtggccagatactgcgacctccctagcaaactggggcacaagcttaattgagtcgaccgagcatcttaccgccatttatacccatatttgttctgtttttcttgatttgggtatacatttaaatgttaatagaacaaaatggtggggcaatcatttacatttttagggatatgtaattactagttcaggtgtattgccacaagacaaacatgttaagaaactttcccgttatttacgctctgttcctgttaatcaacctctggattacaaaatttgtgaaagattgactgatattcttaactatgttgctccttttacgctgtgtggatatgctgctttatagcctctgtatctagctattgcttcccgtacggctttcgttttctcctccttgtataaatcctggttgctgtctcttttagaggagttgtggcccgttgtccgtcaacgtggcgtggtgtgctctgtgtttgctgacgcaacccccactggctggggcattgccaccacctgtcaactcctttctgggactttcgctttccccctcccgatcgccacggcagaactcatcgccgcctgccttgcccgctgctggacaggggctaggttgctgggcactgataattccgtggtgttgtcatcgaattcggtacctttttaaaagaaaaggggggactggaagggctaattcactcccaacgaagacaagatatcataacttcgtatagcatacattatacgaagttataatttatttgtgaaatttgtgatgctattgctttatttgtaaccatatgtttatttgtgaaatttgtgatgctattgctttatttgtaaccattgctttttgcttgtactgggtctctctggttagaccagatctgagcctgggagctctctggctaactagggaacccactgcttaagcctcaataaagcttgcctcgaccagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcctgcagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttag

SEQ ID NO: 47 - protein, 967 aa, Artificial Sequence
  SS-scFvCD19-DmrA-fuP2A-2xDmrB-DmrC-TM-41BB-CD3z protein
METDTLLLWVLLLWVPGSTGDYKDEGSDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSASGSGGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLEGGRARYKRSVSGSGATNFSLLKQAGDVEENPGPSRSGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVEFLKLESGTSGTSGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEGSRSILWHEMWHEGLEEASRLYFGERNVKGMFEVLEPLHAMMERGPQTLKETSFNQAYGRDLMEAQEWCRKYMKSGNVKDLLQAWDLYYHVFRRISKASAKPTTTPAPRPPTPAPTIASQPLSLRPEACRPAAGGAVHTRGLDFACDIYIWAPLAGTCGVLLLSLVITMHKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRG

SEQ ID NO: 48 - DNA, 2901 bp, Artificial Sequence
  SS-scFvCD19-DmrA-fuP2A-2xDmrB-DmrC-TM-41BB-CD3z DNA
atggagacagacacactcctgctatgggtactgctgctctgggttccaggttccactggtgactacaaggacgagggatccgatatccagatgacccagaccaccagcagcctgagcgccagcctgggcgatagagtgaccatcagctgcagagccagccaggacatcagcaagtacctgaactggtatcagcagaaacccgacggcaccgtgaagctgctgatctaccacaccagcagactgcacagcggcgtgcccagcagattttctggcagcggctccggcaccgactacagcctgaccatctccaacctggaacaggaagatatcgctacctacttctgtcagcaaggcaacaccctgccctacaccttcggcggaggcaccaagctggaaatcaccggcagcacaagcggcagcggcaagcctggatctggcgagggaagcaccaagggcgaagtgaaactgcaggaaagcggccctggactggtggccccaagccagtctctgagcgtgacctgtaccgtgtccggcgtgtccctgcctgactatggcgtgtcctggatcagacagccacccagaaagggcctggaatggctgggagtgatctggggcagcgagacaacctactacaacagcgccctgaagtcccggctgaccatcatcaaggacaactccaagagccaggtgttcctgaagatgaacagcctgcagaccgacgacaccgccatctactactgcgccaagcactactactacggcggcagctacgccatggactactggggccagggcacaagcgtgaccgtgtccagcgctagcggctcaggaggagtgcaggttgaaaccatctccccaggagacgggcgcaccttcccgaagcgcggacagacatgcgtggtgcactacaccgggatgcttgaagatggaaagaaattcgattcatcgcgggacagaaacaagccctttaagtttatgctgggcaagcaggaggtcatccgaggctgggaagaaggggttgcccagatgagtgtcggccagagagccaaactgactatatcacctgactacgcctatggggccactgggcaccctggcataattccgccacacgccactctcgtcttcgatgtggagcttctaaaactggaaggcggccgcgctcgttacaagcgaagtgtctcaggatctggcgccacgaacttctctctgttaaagcaagcaggagatgttgaagaaaaccccgggccttcaagatccggcggtgtccaagtcgaaactatatcgcctggcgatggcagaacgtttcccaaacgtggccagacctgtgtcgtacactataccggcatgctagaggatgggaaaaaggttgattccagtcgcgatcggaacaaaccgtttaaattcatgttggggaagcaagaggttatcaggggatgggaagagggtgtcgcgcaaatgtcggttgggcaacgtgcgaaactcacaatttccccggattacgcatacggagctaccggacaccctgggattatcccaccgcatgcgacgctagtgtttgacgtagagttcttgaagctcgaatcaggtacaagcggcacttctggcgtacaggttgagacaattagtcccggagacggacgtacattcccaaagagagggcaaacttgcgtagtccattacactggaatgttggaagacggcaagaaagtggacagttcaagagaccgcaataagcctttcaagtttatgctcggaaaacaggaagtcatacgcggttgggaggaaggcgtggctcagatgagcgtcggacagagggcaaagttgaccatcagtcccgactatgcgtatggcgcgacaggccatcccggaatcatacctccccacgcaaccttggtattcgatgtcgaactgctcaaattagagggtagtagatccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcctccaagcctgggacctctattatcatgtgttccgacgaatctcaaaggctagcgccaagcctaccaccacccctgcccctagacctccaacacccgccccaacaatcgccagccagcctctgtctctgaggcccgaggcttgtagaccagctgctggcggagccgtacacaccagaggactggatttcgcctgcgacatctacatctgggcccctctggccggcacatgtggcgtgctgctgctgagcctcgtgatcaccatgcataaacggggcagaaagaaactcctgtatatattcaaacaaccatttatgagaccagtacaaactactcaagaggaagatggctgtagctgccgatttccagaagaagaagaaggaggatgtgaactgcgggtgaagttcagcagaagcgccgacgcccctgcctaccagcagggccagaatcagctgtacaacgagctgaacctgggcagaagggaagagtacgacgtcctggataagcggagaggccgggaccctgagatgggcggcaagcctcggcggaagaacccccaggaaggcctgtataacgaactgcagaaagacaagatggccgaggcctacagcgagatcggcatgaagggcgagcggaggcggggcaagggccacgacggcctgtatcagggcctgtccaccgccaccaaggatacctacgacgccctgcacatgcaggccctgcccccaaggggc

SEQ ID NO: 49 - DNA, 8984 bp, Artificial Sequence
  SS-scFvCD19-DmrA-fuP2A-2xDmrB-DmrC-TM-41BB-CD3z lentiviral vector
aaaaataaacaaataggggttccgcgcacatttccccgaaaagtgccacctgacgtcaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaatgaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcggttaacttttaaaagaaaaggggggattggggggtacagtgcaggggaaagaatagtagacataatagcaacagacatacaaactaaagaattacaaaaacaaattacaaaaattcaaaattttatcgattacgcgtaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacacctgcagggccgccaccatggagacagacacactcctgctatgggtactgctgctctgggttccaggttccactggtgactacaaggacgagggatccgatatccagatgacccagaccaccagcagcctgagcgccagcctgggcgatagagtgaccatcagctgcagagccagccaggacatcagcaagtacctgaactggtatcagcagaaacccgacggcaccgtgaagctgctgatctaccacaccagcagactgcacagcggcgtgcccagcagattttctggcagcggctccggcaccgactacagcctgaccatctccaacctggaacaggaagatatcgctacctacttctgtcagcaaggcaacaccctgccctacaccttcggcggaggcaccaagctggaaatcaccggcagcacaagcggcagcggcaagcctggatctggcgagggaagcaccaagggcgaagtgaaactgcaggaaagcggccctggactggtggccccaagccagtctctgagcgtgacctgtaccgtgtccggcgtgtccctgcctgactatggcgtgtcctggatcagacagccacccagaaagggcctggaatggctgggagtgatctggggcagcgagacaacctactacaacagcgccctgaagtcccggctgaccatcatcaaggacaactccaagagccaggtgttcctgaagatgaacagcctgcagaccgacgacaccgccatctactactgcgccaagcactactactacggcggcagctacgccatggactactggggccagggcacaagcgtgaccgtgtccagcgctagcggctcaggaggagtgcaggttgaaaccatctccccaggagacgggcgcaccttcccgaagcgcggacagacatgcgtggtgcactacaccgggatgcttgaagatggaaagaaattcgattcatcgcgggacagaaacaagccctttaagtttatgctgggcaagcaggaggtcatccgaggctgggaagaaggggttgcccagatgagtgtcggccagagagccaaactgactatatcacctgactacgcctatggggccactgggcaccctggcataattccgccacacgccactctcgtcttcgatgtggagcttctaaaactggaaggcggccgcgctcgttacaagcgaagtgtctcaggatctggcgccacgaacttctctctgttaaagcaagcaggagatgttgaagaaaaccccgggccttcaagatccggcggtgtccaagtcgaaactatatcgcctggcgatggcagaacgtttcccaaacgtggccagacctgtgtcgtacactataccggcatgctagaggatgggaaaaaggttgattccagtcgcgatcggaacaaaccgtttaaattcatgttggggaagcaagaggttatcaggggatgggaagagggtgtcgcgcaaatgtcggttgggcaacgtgcgaaactcacaatttccccggattacgcatacggagctaccggacaccctgggattatcccaccgcatgcgacgctagtgtttgacgtagagttcttgaagctcgaatcaggtacaagcggcacttctggcgtacaggttgagacaattagtcccggagacggacgtacattcccaaagagagggcaaacttgcgtagtccattacactggaatgttggaagacggcaagaaagtggacagttcaagagaccgcaataagcctttcaagtttatgctcggaaaacaggaagtcatacgcggttgggaggaaggcgtggctcagatgagcgtcggacagagggcaaagttgaccatcagtcccgactatgcgtatggcgcgacaggccatcccggaatcatacctccccacgcaaccttggtattcgatgtcgaactgctcaaattagagggtagtagatccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcctccaagcctgggacctctattatcatgtgttccgacgaatctcaaaggctagcgccaagcctaccaccacccctgcccctagacctccaacacccgccccaacaatcgccagccagcctctgtctctgaggcccgaggcttgtagaccagctgctggcggagccgtacacaccagaggactggatttcgcctgcgacatctacatctgggcccctctggccggcacatgtggcgtgctgctgctgagcctcgtgatcaccatgcataaacggggcagaaagaaactcctgtatatattcaaacaaccatttatgagaccagtacaaactactcaagaggaagatggctgtagctgccgatttccagaagaagaagaaggaggatgtgaactgcgggtgaagttcagcagaagcgccgacgcccctgcctaccagcagggccagaatcagctgtacaacgagctgaacctgggcagaagggaagagtacgacgtcctggataagcggagaggccgggaccctgagatgggcggcaagcctcggcggaagaacccccaggaaggcctgtataacgaactgcagaaagacaagatggccgaggcctacagcgagatcggcatgaagggcgagcggaggcggggcaagggccacgacggcctgtatcagggcctgtccaccgccaccaaggatacctacgacgccctgcacatgcaggccctgcccccaaggggcggccgctccggtgagggcagaggaagtcttctaacatgcggtgacgtggaggagaatccgggcccctctagaagcgagctgattaaggagaacatgcacatgaagctgtacatggagggcaccgtggacaaccatcacttcaagtgcacatccgagggcgaaggcaagccctacgagggcacccagaccatgagaatcaaggtggtcgagggcggccctctccccttcgccttcgacatcctggctactagcttcctctacggcagcaagaccttcatcaaccacacccagggcatccccgacttcttcaagcagtccttccctgagggcttcacatgggagagagtcaccacatacgaagacgggggcgtgctgaccgctacccaggacaccagcctccaggacggctgcctcatctacaacgtcaagatcagaggggtgaacttcacatccaacggccctgtgatgcagaagaaaacactcggctgggaggccttcaccgagacgctgtaccccgctgacggcggcctggaaggcagaaacgacatggccctgaagctcgtgggcgggagccatctgatcgcaaacatcaagaccacatatagatccaagaaacccgctaagaacctcaagatgcctggcgtctactatgtggactacagactggaaagaatcaaggaggccaacaacgagacctacgtcgagcagcacgaggtggcagtggccagatactgcgacctccctagcaaactggggcacaagcttaattgagtcgaccgagcatcttaccgccatttatacccatatttgttctgtttttcttgatttgggtatacatttaaatgttaatagaacaaaatggtggggcaatcatttacatttttagggatatgtaattactagttcaggtgtattgccacaagacaaacatgttaagaaactttcccgttatttacgctctgttcctgttaatcaacctctggattacaaaatttgtgaaagattgactgatattcttaactatgttgctccttttacgctgtgtggatatgctgctttatagcctctgtatctagctattgcttcccgtacggctttcgttttctcctccttgtataaatcctggttgctgtctcttttagaggagttgtggcccgttgtccgtcaacgtggcgtggtgtgctctgtgtttgctgacgcaacccccactggctggggcattgccaccacctgtcaactcctttctgggactttcgctttccccctcccgatcgccacggcagaactcatcgccgcctgccttgcccgctgctggacaggggctaggttgctgggcactgataattccgtggtgttgtcatcgaattcggtacctttttaaaagaaaaggggggactggaagggctaattcactcccaacgaagacaagatatcataacttcgtatagcatacattatacgaagttataatttatttgtgaaatttgtgatgctattgctttatttgtaaccatatgtttatttgtgaaatttgtgatgctattgctttatttgtaaccattgctttttgcttgtactgggtctctctggttagaccagatctgagcctgggagctctctggctaactagggaacccactgcttaagcctcaataaagcttgcctcgaccagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcctgcagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttag

SEQ ID NO: 50 - protein, 406 aa, Artificial Sequence
  SS-CD19scFv-DmrA-CD4TM protein
MPLGLLWLGLALLGALHAQAGSDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSASGGGGSGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLEGGRMALIVLGGVAGLLLFIGLGIFF

SEQ ID NO: 51 - DNA, 1218 bp, Artificial Sequence
  SS-CD19scFv-DmrA-CD4TM DNA
atgcccctgggcctgctgtggctgggcctggccctgctgggcgccctgcacgcccaggccggatccgatatccagatgacccagaccaccagcagcctgagcgccagcctgggcgatagagtgaccatcagctgcagagccagccaggacatcagcaagtacctgaactggtatcagcagaaacccgacggcaccgtgaagctgctgatctaccacaccagcagactgcacagcggcgtgcccagcagattttctggcagcggctccggcaccgactacagcctgaccatctccaacctggaacaggaagatatcgctacctacttctgtcagcaaggcaacaccctgccctacaccttcggcggaggcaccaagctggaaatcaccggcagcacaagcggcagcggcaagcctggatctggcgagggaagcaccaagggcgaagtgaaactgcaggaaagcggccctggactggtggccccaagccagtctctgagcgtgacctgtaccgtgtccggcgtgtccctgcctgactatggcgtgtcctggatcagacagccacccagaaagggcctggaatggctgggagtgatctggggcagcgagacaacctactacaacagcgccctgaagtcccggctgaccatcatcaaggacaactccaagagccaggtgttcctgaagatgaacagcctgcagaccgacgacaccgccatctactactgcgccaagcactactactacggcggcagctacgccatggactactggggccagggcacaagcgtgaccgtgtccagcgctagcggcggaggtgggagcggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaaggcggccgcatggccctgattgtgctggggggcgtcgccggcctcctgcttttcattgggctaggcatcttcttc

SEQ ID NO: 52 - DNA, 7336 bp, Artificial Sequence
  pCVL_sEF1a-T7-hScnSS-CD19scFv-DmrA-CD4TM lentiviral vector
aaaaataaacaaataggggttccgcgcacatttccccgaaaagtgccacctgacgtcaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaatgaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcggttaacttttaaaagaaaaggggggattggggggtacagtgcaggggaaagaatagtagacataatagcaacagacatacaaactaaagaattacaaaaacaaattacaaaaattcaaaattttatcgattacgcgtaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacacctgcaggtaatacgactcactatagggtccactgccgccaccatgcccctgggcctgctgtggctgggcctggccctgctgggcgccctgcacgcccaggccggatccgatatccagatgacccagaccaccagcagcctgagcgccagcctgggcgatagagtgaccatcagctgcagagccagccaggacatcagcaagtacctgaactggtatcagcagaaacccgacggcaccgtgaagctgctgatctaccacaccagcagactgcacagcggcgtgcccagcagattttctggcagcggctccggcaccgactacagcctgaccatctccaacctggaacaggaagatatcgctacctacttctgtcagcaaggcaacaccctgccctacaccttcggcggaggcaccaagctggaaatcaccggcagcacaagcggcagcggcaagcctggatctggcgagggaagcaccaagggcgaagtgaaactgcaggaaagcggccctggactggtggccccaagccagtctctgagcgtgacctgtaccgtgtccggcgtgtccctgcctgactatggcgtgtcctggatcagacagccacccagaaagggcctggaatggctgggagtgatctggggcagcgagacaacctactacaacagcgccctgaagtcccggctgaccatcatcaaggacaactccaagagccaggtgttcctgaagatgaacagcctgcagaccgacgacaccgccatctactactgcgccaagcactactactacggcggcagctacgccatggactactggggccagggcacaagcgtgaccgtgtccagcgctagcggcggaggtgggagcggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaaggcggccgcatggccctgattgtgctggggggcgtcgccggcctcctgcttttcattgggctaggcatcttcttcatgcattccggtgagggcagaggaagtcttctaacatgcggtgacgtggaggagaatccgggcccctctagagtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctctctgcaggacggcgagttcatctacaaggtgaagctgcgcggcaccaacttcccctccgacggccccgtaatgcagaagaagactatgggctgggaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagtaagtcgaccgagcatcttaccgccatttatacccatatttgttctgtttttcttgatttgggtatacatttaaatgttaatagaacaaaatggtggggcaatcatttacatttttagggatatgtaattactagttcaggtgtattgccacaagacaaacatgttaagaaactttcccgttatttacgctctgttcctgttaatcaacctctggattacaaaatttgtgaaagattgactgatattcttaactatgttgctccttttacgctgtgtggatatgctgctttatagcctctgtatctagctattgcttcccgtacggctttcgttttctcctccttgtataaatcctggttgctgtctcttttagaggagttgtggcccgttgtccgtcaacgtggcgtggtgtgctctgtgtttgctgacgcaacccccactggctggggcattgccaccacctgtcaactcctttctgggactttcgctttccccctcccgatcgccacggcagaactcatcgccgcctgccttgcccgctgctggacaggggctaggttgctgggcactgataattccgtggtgttgtcatcgaattcggtacctttttaaaagaaaaggggggactggaagggctaattcactcccaacgaagacaagatatcataacttcgtatagcatacattatacgaagttataatttatttgtgaaatttgtgatgctattgctttatttgtaaccatatgtttatttgtgaaatttgtgatgctattgctttatttgtaaccattgctttttgcttgtactgggtctctctggttagaccagatctgagcctgggagctctctggctaactagggaacccactgcttaagcctcaataaagcttgcctcgaccagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcctgcagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttag

SEQ ID NO: 53 - protein, 453 aa, Artificial Sequence
  SS-CD19scFv-DmrA-CD8hingeTM protein
MPLGLLWLGLALLGALHAQAGSDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSASGGGGSGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLEGGRAKPTTTPAPRPPTPAPTIASQPLSLRPEACRPAAGGAVHTRGLDFACDIYIWAPLAGTCGVLLLSLVIT

SEQ ID NO: 54 - DNA, 1359 bp, Artificial Sequence
  SS-CD19scFv-DmrA-CD8hingeTM DNA
atgcccctgggcctgctgtggctgggcctggccctgctgggcgccctgcacgcccaggccggatccgatatccagatgacccagaccaccagcagcctgagcgccagcctgggcgatagagtgaccatcagctgcagagccagccaggacatcagcaagtacctgaactggtatcagcagaaacccgacggcaccgtgaagctgctgatctaccacaccagcagactgcacagcggcgtgcccagcagattttctggcagcggctccggcaccgactacagcctgaccatctccaacctggaacaggaagatatcgctacctacttctgtcagcaaggcaacaccctgccctacaccttcggcggaggcaccaagctggaaatcaccggcagcacaagcggcagcggcaagcctggatctggcgagggaagcaccaagggcgaagtgaaactgcaggaaagcggccctggactggtggccccaagccagtctctgagcgtgacctgtaccgtgtccggcgtgtccctgcctgactatggcgtgtcctggatcagacagccacccagaaagggcctggaatggctgggagtgatctggggcagcgagacaacctactacaacagcgccctgaagtcccggctgaccatcatcaaggacaactccaagagccaggtgttcctgaagatgaacagcctgcagaccgacgacaccgccatctactactgcgccaagcactactactacggcggcagctacgccatggactactggggccagggcacaagcgtgaccgtgtccagcgctagcggcggaggtgggagcggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaaggcggccgcgccaagcctaccaccacccctgcccctagacctccaacacccgccccaacaatcgccagccagcctctgtctctgaggcccgaggcttgtagaccagctgctggcggagccgtgcacaccagaggactggatttcgcctgcgacatctacatctgggcccctctggccggcacatgtggcgtgctgctgctgagcctcgtgatcacc

SEQ ID NO: 55 - DNA, 7477 bp, Artificial Sequence
  pCVL_sEF1a-T7-hScnSS-CD19scFv-DmrA-CD8hingeTM lentiviral vector
aaaaataaacaaataggggttccgcgcacatttccccgaaaagtgccacctgacgtcaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaatgaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcggttaacttttaaaagaaaaggggggattggggggtacagtgcaggggaaagaatagtagacataatagcaacagacatacaaactaaagaattacaaaaacaaattacaaaaattcaaaattttatcgattacgcgtaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacacctgcaggtaatacgactcactatagggtccactgccgccaccatgcccctgggcctgctgtggctgggcctggccctgctgggcgccctgcacgcccaggccggatccgatatccagatgacccagaccaccagcagcctgagcgccagcctgggcgatagagtgaccatcagctgcagagccagccaggacatcagcaagtacctgaactggtatcagcagaaacccgacggcaccgtgaagctgctgatctaccacaccagcagactgcacagcggcgtgcccagcagattttctggcagcggctccggcaccgactacagcctgaccatctccaacctggaacaggaagatatcgctacctacttctgtcagcaaggcaacaccctgccctacaccttcggcggaggcaccaagctggaaatcaccggcagcacaagcggcagcggcaagcctggatctggcgagggaagcaccaagggcgaagtgaaactgcaggaaagcggccctggactggtggccccaagccagtctctgagcgtgacctgtaccgtgtccggcgtgtccctgcctgactatggcgtgtcctggatcagacagccacccagaaagggcctggaatggctgggagtgatctggggcagcgagacaacctactacaacagcgccctgaagtcccggctgaccatcatcaaggacaactccaagagccaggtgttcctgaagatgaacagcctgcagaccgacgacaccgccatctactactgcgccaagcactactactacggcggcagctacgccatggactactggggccagggcacaagcgtgaccgtgtccagcgctagcggcggaggtgggagcggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaaggcggccgcgccaagcctaccaccacccctgcccctagacctccaacacccgccccaacaatcgccagccagcctctgtctctgaggcccgaggcttgtagaccagctgctggcggagccgtgcacaccagaggactggatttcgcctgcgacatctacatctgggcccctctggccggcacatgtggcgtgctgctgctgagcctcgtgatcaccatgcattccggtgagggcagaggaagtcttctaacatgcggtgacgtggaggagaatccgggcccctctagagtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctctctgcaggacggcgagttcatctacaaggtgaagctgcgcggcaccaacttcccctccgacggccccgtaatgcagaagaagactatgggctgggaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagtaagtcgaccgagcatcttaccgccatttatacccatatttgttctgtttttcttgatttgggtatacatttaaatgttaatagaacaaaatggtggggcaatcatttacatttttagggatatgtaattactagttcaggtgtattgccacaagacaaacatgttaagaaactttcccgttatttacgctctgttcctgttaatcaacctctggattacaaaatttgtgaaagattgactgatattcttaactatgttgctccttttacgctgtgtggatatgctgctttatagcctctgtatctagctattgcttcccgtacggctttcgttttctcctccttgtataaatcctggttgctgtctcttttagaggagttgtggcccgttgtccgtcaacgtggcgtggtgtgctctgtgtttgctgacgcaacccccactggctggggcattgccaccacctgtcaactcctttctgggactttcgctttccccctcccgatcgccacggcagaactcatcgccgcctgccttgcccgctgctggacaggggctaggttgctgggcactgataattccgtggtgttgtcatcgaattcggtacctttttaaaagaaaaggggggactggaagggctaattcactcccaacgaagacaagatatcataacttcgtatagcatacattatacgaagttataatttatttgtgaaatttgtgatgctattgctttatttgtaaccatatgtttatttgtgaaatttgtgatgctattgctttatttgtaaccattgctttttgcttgtactgggtctctctggttagaccagatctgagcctgggagctctctggctaactagggaacccactgcttaagcctcaataaagcttgcctcgaccagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcctgcagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttag

SEQ ID NO: 56 - protein, 635 aa, Artificial Sequence
  SS-CD19scFv-DmrA-Spacer-CD4TM protein
MPLGLLWLGLALLGALHAQAGSDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSASGGGGSGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLEGGRESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKMALIVLGGVAGLLLFIGLGIFF

SEQ ID NO: 57 - DNA, 1905 bp, Artificial Sequence
  SS-CD19scFv-DmrA-Spacer-CD4TM DNA
atgcccctgggcctgctgtggctgggcctggccctgctgggcgccctgcacgcccaggccggatccgatatccagatgacccagaccaccagcagcctgagcgccagcctgggcgatagagtgaccatcagctgcagagccagccaggacatcagcaagtacctgaactggtatcagcagaaacccgacggcaccgtgaagctgctgatctaccacaccagcagactgcacagcggcgtgcccagcagattttctggcagcggctccggcaccgactacagcctgaccatctccaacctggaacaggaagatatcgctacctacttctgtcagcaaggcaacaccctgccctacaccttcggcggaggcaccaagctggaaatcaccggcagcacaagcggcagcggcaagcctggatctggcgagggaagcaccaagggcgaagtgaaactgcaggaaagcggccctggactggtggccccaagccagtctctgagcgtgacctgtaccgtgtccggcgtgtccctgcctgactatggcgtgtcctggatcagacagccacccagaaagggcctggaatggctgggagtgatctggggcagcgagacaacctactacaacagcgccctgaagtcccggctgaccatcatcaaggacaactccaagagccaggtgttcctgaagatgaacagcctgcagaccgacgacaccgccatctactactgcgccaagcactactactacggcggcagctacgccatggactactggggccagggcacaagcgtgaccgtgtccagcgctagcggcggaggtgggagcggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaaggcggccgcgagagcaagtacggaccgccctgcccaccttgccctgcccccgagttcctgggcggacccagcgtgttcctgttcccacccaagcccaaggacaccctgatgatcagccggacccccgaggtgacctgcgtggtggtggacgtgagccaggaagatcccgaggtccagttcaattggtacgtggacggcgtggaagtgcacaacgccaagaccaagcccagagaggaacagttcaacagcacctaccgggtggtgtctgtgctgaccgtgctgcaccaggactggctgaacggcaaagaatacaagtgcaaggtgtccaacaagggcctgcccagcagcatcgaaaagaccatcagcaaggccaagggccagcctcgcgagccccaggtgtacaccctgcctccctcccaggaagagatgaccaagaaccaggtgtccctgacctgcctggtgaagggcttctaccccagcgacatcgccgtggagtgggagagcaacggccagcctgagaacaactacaagaccacccctcccgtgctggacagcgacggcagcttcttcctgtacagccggctgaccgtggacaagagccggtggcaggaaggcaacgtctttagctgcagcgtgatgcacgaggccctgcacaaccactacacccagaagagcctgagcctgtccctgggcaagatggccctgattgtgctggggggcgtcgccggcctcctgcttttcattgggctaggcatcttcttc

SEQ ID NO: 58 - DNA, 8023 bp, Artificial Sequence
  pCVL_sEF1a-T7-hScnSS-CD19scFv-DmrA-Spacer-CD4TM lentiviral vector
aaaaataaacaaataggggttccgcgcacatttccccgaaaagtgccacctgacgtcaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaatgaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcggttaacttttaaaagaaaaggggggattggggggtacagtgcaggggaaagaatagtagacataatagcaacagacatacaaactaaagaattacaaaaacaaattacaaaaattcaaaattttatcgattacgcgtaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacacctgcaggtaatacgactcactatagggtccactgccgccaccatgcccctgggcctgctgtggctgggcctggccctgctgggcgccctgcacgcccaggccggatccgatatccagatgacccagaccaccagcagcctgagcgccagcctgggcgatagagtgaccatcagctgcagagccagccaggacatcagcaagtacctgaactggtatcagcagaaacccgacggcaccgtgaagctgctgatctaccacaccagcagactgcacagcggcgtgcccagcagattttctggcagcggctccggcaccgactacagcctgaccatctccaacctggaacaggaagatatcgctacctacttctgtcagcaaggcaacaccctgccctacaccttcggcggaggcaccaagctggaaatcaccggcagcacaagcggcagcggcaagcctggatctggcgagggaagcaccaagggcgaagtgaaactgcaggaaagcggccctggactggtggccccaagccagtctctgagcgtgacctgtaccgtgtccggcgtgtccctgcctgactatggcgtgtcctggatcagacagccacccagaaagggcctggaatggctgggagtgatctggggcagcgagacaacctactacaacagcgccctgaagtcccggctgaccatcatcaaggacaactccaagagccaggtgttcctgaagatgaacagcctgcagaccgacgacaccgccatctactactgcgccaagcactactactacggcggcagctacgccatggactactggggccagggcacaagcgtgaccgtgtccagcgctagcggcggaggtgggagcggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaaggcggccgcgagagcaagtacggaccgccctgcccaccttgccctgcccccgagttcctgggcggacccagcgtgttcctgttcccacccaagcccaaggacaccctgatgatcagccggacccccgaggtgacctgcgtggtggtggacgtgagccaggaagatcccgaggtccagttcaattggtacgtggacggcgtggaagtgcacaacgccaagaccaagcccagagaggaacagttcaacagcacctaccgggtggtgtctgtgctgaccgtgctgcaccaggactggctgaacggcaaagaatacaagtgcaaggtgtccaacaagggcctgcccagcagcatcgaaaagaccatcagcaaggccaagggccagcctcgcgagccccaggtgtacaccctgcctccctcccaggaagagatgaccaagaaccaggtgtccctgacctgcctggtgaagggcttctaccccagcgacatcgccgtggagtgggagagcaacggccagcctgagaacaactacaagaccacccctcccgtgctggacagcgacggcagcttcttcctgtacagccggctgaccgtggacaagagccggtggcaggaaggcaacgtctttagctgcagcgtgatgcacgaggccctgcacaaccactacacccagaagagcctgagcctgtccctgggcaagatggccctgattgtgctggggggcgtcgccggcctcctgcttttcattgggctaggcatcttcttcatgcattccggtgagggcagaggaagtcttctaacatgcggtgacgtggaggagaatccgggcccctctagagtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctctctgcaggacggcgagttcatctacaaggtgaagctgcgcggcaccaacttcccctccgacggccccgtaatgcagaagaagactatgggctgggaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagtaagtcgaccgagcatcttaccgccatttatacccatatttgttctgtttttcttgatttgggtatacatttaaatgttaatagaacaaaatggtggggcaatcatttacatttttagggatatgtaattactagttcaggtgtattgccacaagacaaacatgttaagaaactttcccgttatttacgctctgttcctgttaatcaacctctggattacaaaatttgtgaaagattgactgatattcttaactatgttgctccttttacgctgtgtggatatgctgctttatagcctctgtatctagctattgcttcccgtacggctttcgttttctcctccttgtataaatcctggttgctgtctcttttagaggagttgtggcccgttgtccgtcaacgtggcgtggtgtgctctgtgtttgctgacgcaacccccactggctggggcattgccaccacctgtcaactcctttctgggactttcgctttccccctcccgatcgccacggcagaactcatcgccgcctgccttgcccgctgctggacaggggctaggttgctgggcactgataattccgtggtgttgtcatcgaattcggtacctttttaaaagaaaaggggggactggaagggctaattcactcccaacgaagacaagatatcataacttcgtatagcatacattatacgaagttataatttatttgtgaaatttgtgatgctattgctttatttgtaaccatatgtttatttgtgaaatttgtgatgctattgctttatttgtaaccattgctttttgcttgtactgggtctctctggttagaccagatctgagcctgggagctctctggctaactagggaacccactgcttaagcctcaataaagcttgcctcgaccagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcctgcagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttag

SEQ ID NO: 59 - protein, 417 aa, Artificial Sequence
  SS-CD19scFv-DmrA-CD52 GPI anchor protein
MPLGLLWLGLALLGALHAQAGSDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSASGGGGSGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLEGGRTSQTSSPSASSNISGGIFLFFVANAIIHLFCFS

SEQ ID NO: 60 - DNA, 1251 bp, Artificial Sequence
  SS-CD19scFv-DmrA-CD52 GPI anchor DNA
atgcccctgggcctgctgtggctgggcctggccctgctgggcgccctgcacgcccaggccggatccgatatccagatgacccagaccaccagcagcctgagcgccagcctgggcgatagagtgaccatcagctgcagagccagccaggacatcagcaagtacctgaactggtatcagcagaaacccgacggcaccgtgaagctgctgatctaccacaccagcagactgcacagcggcgtgcccagcagattttctggcagcggctccggcaccgactacagcctgaccatctccaacctggaacaggaagatatcgctacctacttctgtcagcaaggcaacaccctgccctacaccttcggcggaggcaccaagctggaaatcaccggcagcacaagcggcagcggcaagcctggatctggcgagggaagcaccaagggcgaagtgaaactgcaggaaagcggccctggactggtggccccaagccagtctctgagcgtgacctgtaccgtgtccggcgtgtccctgcctgactatggcgtgtcctggatcagacagccacccagaaagggcctggaatggctgggagtgatctggggcagcgagacaacctactacaacagcgccctgaagtcccggctgaccatcatcaaggacaactccaagagccaggtgttcctgaagatgaacagcctgcagaccgacgacaccgccatctactactgcgccaagcactactactacggcggcagctacgccatggactactggggccagggcacaagcgtgaccgtgtccagcgctagcggcggaggtgggagcggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaaggcggccgcaccagccaaaccagcagcccctcagcatccagcaacataagcggaggcattttccttttcttcgtggccaatgccataatccacctcttctgcttcagt

SEQ ID NO: 61 - DNA, 7369 bp, Artificial Sequence
  pCVL_sEF1a-T7-hScnSS-CD19scFv-DmrA-CD52 GPI anchor lentiviral vector
aaaaataaacaaataggggttccgcgcacatttccccgaaaagtgccacctgacgtcaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaatgaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcggttaacttttaaaagaaaaggggggattggggggtacagtgcaggggaaagaatagtagacataatagcaacagacatacaaactaaagaattacaaaaacaaattacaaaaattcaaaattttatcgattacgcgtaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacacctgcaggtaatacgactcactatagggtccactgccgccaccatgcccctgggcctgctgtggctgggcctggccctgctgggcgccctgcacgcccaggccggatccgatatccagatgacccagaccaccagcagcctgagcgccagcctgggcgatagagtgaccatcagctgcagagccagccaggacatcagcaagtacctgaactggtatcagcagaaacccgacggcaccgtgaagctgctgatctaccacaccagcagactgcacagcggcgtgcccagcagattttctggcagcggctccggcaccgactacagcctgaccatctccaacctggaacaggaagatatcgctacctacttctgtcagcaaggcaacaccctgccctacaccttcggcggaggcaccaagctggaaatcaccggcagcacaagcggcagcggcaagcctggatctggcgagggaagcaccaagggcgaagtgaaactgcaggaaagcggccctggactggtggccccaagccagtctctgagcgtgacctgtaccgtgtccggcgtgtccctgcctgactatggcgtgtcctggatcagacagccacccagaaagggcctggaatggctgggagtgatctggggcagcgagacaacctactacaacagcgccctgaagtcccggctgaccatcatcaaggacaactccaagagccaggtgttcctgaagatgaacagcctgcagaccgacgacaccgccatctactactgcgccaagcactactactacggcggcagctacgccatggactactggggccagggcacaagcgtgaccgtgtccagcgctagcggcggaggtgggagcggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaaggcggccgcaccagccaaaccagcagcccctcagcatccagcaacataagcggaggcattttccttttcttcgtggccaatgccataatccacctcttctgcttcagtatgcattccggtgagggcagaggaagtcttctaacatgcggtgacgtggaggagaatccgggcccctctagagtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctctctgcaggacggcgagttcatctacaaggtgaagctgcgcggcaccaacttcccctccgacggccccgtaatgcagaagaagactatgggctgggaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagtaagtcgaccgagcatcttaccgccatttatacccatatttgttctgtttttcttgatttgggtatacatttaaatgttaatagaacaaaatggtggggcaatcatttacatttttagggatatgtaattactagttcaggtgtattgccacaagacaaacatgttaagaaactttcccgttatttacgctctgttcctgttaatcaacctctggattacaaaatttgtgaaagattgactgatattcttaactatgttgctccttttacgctgtgtggatatgctgctttatagcctctgtatctagctattgcttcccgtacggctttcgttttctcctccttgtataaatcctggttgctgtctcttttagaggagttgtggcccgttgtccgtcaacgtggcgtggtgtgctctgtgtttgctgacgcaacccccactggctggggcattgccaccacctgtcaactcctttctgggactttcgctttccccctcccgatcgccacggcagaactcatcgccgcctgccttgcccgctgctggacaggggctaggttgctgggcactgataattccgtggtgttgtcatcgaattcggtacctttttaaaagaaaaggggggactggaagggctaattcactcccaacgaagacaagatatcataacttcgtatagcatacattatacgaagttataatttatttgtgaaatttgtgatgctattgctttatttgtaaccatatgtttatttgtgaaatttgtgatgctattgctttatttgtaaccattgctttttgcttgtactgggtctctctggttagaccagatctgagcctgggagctctctggctaactagggaacccactgcttaagcctcaataaagcttgcctcgaccagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcctgcagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttag

SEQ ID NO: 62 - DNA, 7141 bp, Artificial Sequence
  pCVL_T7_FRB-TM-41BB-CD3z lentiviral vector
aaaaataaacaaataggggttccgcgcacatttccccgaaaagtgccacctgacgtcaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaatgaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcggttaacttttaaaagaaaaggggggattggggggtacagtgcaggggaaagaatagtagacataatagcaacagacatacaaactaaagaattacaaaaacaaattacaaaaattcaaaattttatcgattacgcgtaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacacctgcaggtaatacgactcactatagggtccactgccgccaccatggctctgcctgtgacagctctgctgctgcctctggccctgctgctccatgccgccagacccggatccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcacccaagcctgggacctctattatcatgtgttccgacgaatctcaaaggctagcgccaagcctaccaccacccctgcccctagacctccaacacccgccccaacaatcgccagccagcctctgtctctgaggcccgaggcttgtagaccagctgctggcggagccgtgcacaccagaggactggatttcgcctgcgacatctacatctgggcccctctggccggcacatgtggcgtgctgctgctgagcctcgtgatcaccatgcataaacggggcagaaagaaactcctgtatatattcaaacaaccatttatgagaccagtacaaactactcaagaggaagatggctgtagctgccgatttccagaagaagaagaaggaggatgtgaactgcgggtgaagttcagcagaagcgccgacgcccctgcctaccagcagggccagaatcagctgtacaacgagctgaacctgggcagaagggaagagtacgacgtcctggataagcggagaggccgggaccctgagatgggcggcaagcctcggcggaagaacccccaggaaggcctgtataacgaactgcagaaagacaagatggccgaggcctacagcgagatcggcatgaagggcgagcggaggcggggcaagggccacgacggcctgtatcagggcctgtccaccgccaccaaggatacctacgacgccctgcacatgcaggccctgcccccaaggggcggccgctccggtgagggcagaggaagtcttctaacatgcggtgacgtggaggagaatccgggcccctctagaagcgagctgattaaggagaacatgcacatgaagctgtacatggagggcaccgtggacaaccatcacttcaagtgcacatccgagggcgaaggcaagccctacgagggcacccagaccatgagaatcaaggtggtcgagggcggccctctccccttcgccttcgacatcctggctactagcttcctctacggcagcaagaccttcatcaaccacacccagggcatccccgacttcttcaagcagtccttccctgagggcttcacatgggagagagtcaccacatacgaagacgggggcgtgctgaccgctacccaggacaccagcctccaggacggctgcctcatctacaacgtcaagatcagaggggtgaacttcacatccaacggccctgtgatgcagaagaaaacactcggctgggaggccttcaccgagacgctgtaccccgctgacggcggcctggaaggcagaaacgacatggccctgaagctcgtgggcgggagccatctgatcgcaaacatcaagaccacatatagatccaagaaacccgctaagaacctcaagatgcctggcgtctactatgtggactacagactggaaagaatcaaggaggccaacaacgagacctacgtcgagcagcacgaggtggcagtggccagatactgcgacctccctagcaaactggggcacaagcttaattgagtcgaccgagcatcttaccgccatttatacccatatttgttctgtttttcttgatttgggtatacatttaaatgttaatagaacaaaatggtggggcaatcatttacatttttagggatatgtaattactagttcaggtgtattgccacaagacaaacatgttaagaaactttcccgttatttacgctctgttcctgttaatcaacctctggattacaaaatttgtgaaagattgactgatattcttaactatgttgctccttttacgctgtgtggatatgctgctttatagcctctgtatctagctattgcttcccgtacggctttcgttttctcctccttgtataaatcctggttgctgtctcttttagaggagttgtggcccgttgtccgtcaacgtggcgtggtgtgctctgtgtttgctgacgcaacccccactggctggggcattgccaccacctgtcaactcctttctgggactttcgctttccccctcccgatcgccacggcagaactcatcgccgcctgccttgcccgctgctggacaggggctaggttgctgggcactgataattccgtggtgttgtcatcgaattcggtacctttttaaaagaaaaggggggactggaagggctaattcactcccaacgaagacaagatatcataacttcgtatagcatacattatacgaagttataatttatttgtgaaatttgtgatgctattgctttatttgtaaccatatgtttatttgtgaaatttgtgatgctattgctttatttgtaaccattgctttttgcttgtactgggtctctctggttagaccagatctgagcctgggagctctctggctaactagggaacccactgcttaagcctcaataaagcttgcctcgaccagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcctgcagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttag

SEQ ID NO: 63 - DNA, 7264 bp, Artificial Sequence
  pCVL_T7_scFvCD19-DmrA-mCherry lentiviral vector
aaaaataaacaaataggggttccgcgcacatttccccgaaaagtgccacctgacgtcaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaatgaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcggttaacttttaaaagaaaaggggggattggggggtacagtgcaggggaaagaatagtagacataatagcaacagacatacaaactaaagaattacaaaaacaaattacaaaaattcaaaattttatcgattacgcgtaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacacctgcaggtaatacgactcactatagggtccactgccgccaccatgcccctgggcctgctgtggctgggcctggccctgctgggcgccctgcacgcccaggccggatccgatatccagatgacccagaccaccagcagcctgagcgccagcctgggcgatagagtgaccatcagctgcagagccagccaggacatcagcaagtacctgaactggtatcagcagaaacccgacggcaccgtgaagctgctgatctaccacaccagcagactgcacagcggcgtgcccagcagattttctggcagcggctccggcaccgactacagcctgaccatctccaacctggaacaggaagatatcgctacctacttctgtcagcaaggcaacaccctgccctacaccttcggcggaggcaccaagctggaaatcaccggcagcacaagcggcagcggcaagcctggatctggcgagggaagcaccaagggcgaagtgaaactgcaggaaagcggccctggactggtggccccaagccagtctctgagcgtgacctgtaccgtgtccggcgtgtccctgcctgactatggcgtgtcctggatcagacagccacccagaaagggcctggaatggctgggagtgatctggggcagcgagacaacctactacaacagcgccctgaagtcccggctgaccatcatcaaggacaactccaagagccaggtgttcctgaagatgaacagcctgcagaccgacgacaccgccatctactactgcgccaagcactactactacggcggcagctacgccatggactactggggccagggcacaagcgtgaccgtgtccagcgctagcggcggaggtgggagcggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaaggcggccgctccggtgagggcagaggaagtcttctaacatgcggtgacgtggaggagaatccgggcccctctagagtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctctctgcaggacggcgagttcatctacaaggtgaagctgcgcggcaccaacttcccctccgacggccccgtaatgcagaagaagactatgggctgggaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagtaagtcgaccgagcatcttaccgccatttatacccatatttgttctgtttttcttgatttgggtatacatttaaatgttaatagaacaaaatggtggggcaatcatttacatttttagggatatgtaattactagttcaggtgtattgccacaagacaaacatgttaagaaactttcccgttatttacgctctgttcctgttaatcaacctctggattacaaaatttgtgaaagattgactgatattcttaactatgttgctccttttacgctgtgtggatatgctgctttatagcctctgtatctagctattgcttcccgtacggctttcgttttctcctccttgtataaatcctggttgctgtctcttttagaggagttgtggcccgttgtccgtcaacgtggcgtggtgtgctctgtgtttgctgacgcaacccccactggctggggcattgccaccacctgtcaactcctttctgggactttcgctttccccctcccgatcgccacggcagaactcatcgccgcctgccttgcccgctgctggacaggggctaggttgctgggcactgataattccgtggtgttgtcatcgaattcggtacctttttaaaagaaaaggggggactggaagggctaattcactcccaacgaagacaagatatcataacttcgtatagcatacattatacgaagttataatttatttgtgaaatttgtgatgctattgctttatttgtaaccatatgtttatttgtgaaatttgtgatgctattgctttatttgtaaccattgctttttgcttgtactgggtctctctggttagaccagatctgagcctgggagctctctggctaactagggaacccactgcttaagcctcaataaagcttgcctcgaccagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcctgcagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttag

SEQ ID NO: 64 - protein, 740 aa, Artificial Sequence
  CD8ss-DmrC-CD8TM-41BB-CD3z-P2A-IgKss-CD19scFv-DmrA-CD4TM protein
MALPVTALLLPLALLLHAARPGSILWHEMWHEGLEEASRLYFGERNVKGMFEVLEPLHAMMERGPQTLKETSFNQAYGRDLMEAQEWCRKYMKSGNVKDLLQAWDLYYHVFRRISKASAGTGSDIYIWAPLAGTCGVLLLSLVITMHKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSGSGATNFSLLKQAGDVEENPGPSMETDTLLLWVLLLWVPGSTGSDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSASGGGGSGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLEGGRMALIVLGGVAGLLLFIGLGIFFCVRCRHRRRQ

SEQ ID NO: 65 - DNA, 2223 bp, Artificial Sequence
  CD8ss-DmrC-CD8TM-41BB-CD3z-P2A-IgKss-CD19scFv-DmrA-CD4TM DNA
atggctctgcctgtgacagctctgctgctgcctctggccctgctgctccatgccgccagacccggatccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcctccaagcctgggacctctattatcatgtgttccgacgaatctcaaaggctagcgccggcactggttccgacatctacatctgggcccctctggccggcacatgtggcgtgctgctgctgagcctcgtgatcaccatgcataaacggggcagaaagaaactcctgtatatattcaaacaaccatttatgagaccagtacaaactactcaagaggaagatggctgtagctgccgatttccagaagaagaagaaggaggatgtgaactgcgggtgaagttcagcagaagcgccgacgcccctgcctaccagcagggccagaatcagctgtacaacgagctgaacctgggcagaagggaagagtacgacgtcctggataagcggagaggccgggaccctgagatgggcggcaagcctcggcggaagaacccccaggaaggcctgtataacgaactgcagaaagacaagatggccgaggcctacagcgagatcggcatgaagggcgagcggaggcggggcaagggccacgacggcctgtatcagggcctgtccaccgccaccaaggatacctacgacgccctgcacatgcaggccctgcccccaaggtcaggatctggcgccacgaacttctctctgttaaagcaagcaggagatgttgaagaaaaccccgggccttcaatggagacagacacactcctgctatgggtactgctgctctgggttccaggttccactggttccgatatccagatgacccagaccaccagcagcctgagcgccagcctgggcgatagagtgaccatcagctgcagagccagccaggacatcagcaagtacctgaactggtatcagcagaaacccgacggcaccgtgaagctgctgatctaccacaccagcagactgcacagcggcgtgcccagcagattttctggcagcggctccggcaccgactacagcctgaccatctccaacctggaacaggaagatatcgctacctacttctgtcagcaaggcaacaccctgccctacaccttcggcggaggcaccaagctggaaatcaccggcagcacaagcggcagcggcaagcctggatctggcgagggaagcaccaagggcgaagtgaaactgcaggaaagcggccctggactggtggccccaagccagtctctgagcgtgacctgtaccgtgtccggcgtgtccctgcctgactatggcgtgtcctggatcagacagccacccagaaagggcctggaatggctgggagtgatctggggcagcgagacaacctactacaacagcgccctgaagtcccggctgaccatcatcaaggacaactccaagagccaggtgttcctgaagatgaacagcctgcagaccgacgacaccgccatctactactgcgccaagcactactactacggcggcagctacgccatggactactggggccagggcacaagcgtgaccgtgtccagcgctagcggcggaggtgggagcggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaaggcggccgcatggccctgattgtgctggggggcgtcgccggcctcctgcttttcattgggctaggcatcttcttctgtgtcaggtgccggcaccgaaggcgccaataa

SEQ ID NO: 66 - DNA, 7651 bp, Artificial Sequence
  pCVL_MND-CD8ss-DmrC-CD8TM-41BB-CD3z-P2A-IgKss-CD19scFv-DmrA-CD4TM lentiviral vector
aatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaatgaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcggttaacttttaaaagaaaaggggggattggggggtacagtgcaggggaaagaatagtagacataatagcaacagacatacaaactaaagaattacaaaaacaaattacaaaaattcaaaattttatcgattacgcgtgtacagagagacagcagaatatgggccaaacaggatatctgtggtaagcagttcctgccccggctcagggccaagaacagttggaacagcagaatatgggccaaacaggatatctgtggtaagcagttcctgccccggctcagggccaagaacagatggtccccagatgcggtcccgccctcagcagtttctagagaaccatcagatgtttccagggtgccccaaggacctgaaatgaccctgtgccttatttgaactaaccaatcagttcgcttctcgcttctgttcgcgcgcttctgctccccgagctctatataagcagagctcgtttagtgaaccgtcagatccctgcagggccgccaccatggctctgcctgtgacagctctgctgctgcctctggccctgctgctccatgccgccagacccggatccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcctccaagcctgggacctctattatcatgtgttccgacgaatctcaaaggctagcgccggcactggttccgacatctacatctgggcccctctggccggcacatgtggcgtgctgctgctgagcctcgtgatcaccatgcataaacggggcagaaagaaactcctgtatatattcaaacaaccatttatgagaccagtacaaactactcaagaggaagatggctgtagctgccgatttccagaagaagaagaaggaggatgtgaactgcgggtgaagttcagcagaagcgccgacgcccctgcctaccagcagggccagaatcagctgtacaacgagctgaacctgggcagaagggaagagtacgacgtcctggataagcggagaggccgggaccctgagatgggcggcaagcctcggcggaagaacccccaggaaggcctgtataacgaactgcagaaagacaagatggccgaggcctacagcgagatcggcatgaagggcgagcggaggcggggcaagggccacgacggcctgtatcagggcctgtccaccgccaccaaggatacctacgacgccctgcacatgcaggccctgcccccaaggtcaggatctggcgccacgaacttctctctgttaaagcaagcaggagatgttgaagaaaaccccgggccttcaatggagacagacacactcctgctatgggtactgctgctctgggttccaggttccactggttccgatatccagatgacccagaccaccagcagcctgagcgccagcctgggcgatagagtgaccatcagctgcagagccagccaggacatcagcaagtacctgaactggtatcagcagaaacccgacggcaccgtgaagctgctgatctaccacaccagcagactgcacagcggcgtgcccagcagattttctggcagcggctccggcaccgactacagcctgaccatctccaacctggaacaggaagatatcgctacctacttctgtcagcaaggcaacaccctgccctacaccttcggcggaggcaccaagctggaaatcaccggcagcacaagcggcagcggcaagcctggatctggcgagggaagcaccaagggcgaagtgaaactgcaggaaagcggccctggactggtggccccaagccagtctctgagcgtgacctgtaccgtgtccggcgtgtccctgcctgactatggcgtgtcctggatcagacagccacccagaaagggcctggaatggctgggagtgatctggggcagcgagacaacctactacaacagcgccctgaagtcccggctgaccatcatcaaggacaactccaagagccaggtgttcctgaagatgaacagcctgcagaccgacgacaccgccatctactactgcgccaagcactactactacggcggcagctacgccatggactactggggccagggcacaagcgtgaccgtgtccagcgctagcggcggaggtgggagcggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaaggcggccgcatggccctgattgtgctggggggcgtcgccggcctcctgcttttcattgggctaggcatcttcttctgtgtcaggtgccggcaccgaaggcgccaataagtcgaccgagcatcttaccgccatttatacccatatttgttctgtttttcttgatttgggtatacatttaaatgttaatagaacaaaatggtggggcaatcatttacatttttagggatatgtaattactagttcaggtgtattgccacaagacaaacatgttaagaaactttcccgttatttacgctctgttcctgttaatcaacctctggattacaaaatttgtgaaagattgactgatattcttaactatgttgctccttttacgctgtgtggatatgctgctttatagcctctgtatctagctattgcttcccgtacggctttcgttttctcctccttgtataaatcctggttgctgtctcttttagaggagttgtggcccgttgtccgtcaacgtggcgtggtgtgctctgtgtttgctgacgcaacccccactggctggggcattgccaccacctgtcaactcctttctgggactttcgctttccccctcccgatcgccacggcagaactcatcgccgcctgccttgcccgctgctggacaggggctaggttgctgggcactgataattccgtggtgttgtcatcgaattcggtacctttttaaaagaaaaggggggactggaagggctaattcactcccaacgaagacaagatatcataacttcgtatagcatacattatacgaagttataatttatttgtgaaatttgtgatgctattgctttatttgtaaccatatgtttatttgtgaaatttgtgatgctattgctttatttgtaaccattgctttttgcttgtactgggtctctctggttagaccagatctgagcctgggagctctctggctaactagggaacccactgcttaagcctcaataaagcttgcctcgaccagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcctgcagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtc

SEQ ID NO: 67 - protein, 739 aa, Artificial Sequence
  CD8ss-DmrC-CD8TM-41BB-CD3z-P2A-IgKss-CD19scFv-DmrA-CD4TM codon optimized protein
MALPVTALLLPLALLLHAARPGSILWHEMWHEGLEEASRLYFGERNVKGMFEVLEPLHAMMERGPQTLKETSFNQAYGRDLMEAQEWCRKYMKSGNVKDLLQAWDLYYHVFRRISKASAGTGSDIYIWAPLAGTCGVLLLSLVITMHKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSGSGATNFSLLKQAGDVEENPGPSMETDTLLLWVLLLWVPGSTGDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSPRGGGGSGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLEGGRMALIVLGGVAGLLLFIGLGIFFCVRCRHRRRQ

SEQ ID NO: 68 - DNA, 2220 bp, Artificial Sequence
  CD8ss-DmrC-CD8TM-41BB-CD3z-P2A-IgKss-CD19scFv-DmrA-CD4TM codon optimized DNA
atggccctccctgtgaccgccctgctgctccccctcgccctgttgctccatgctgcccgacctggatccatcctttggcacgagatgtggcacgagggactcgaagaagcgtcccggctgtacttcggagagcggaacgtgaaggggatgttcgaagtgctggaacccctgcacgccatgatggagcggggtcctcagacccttaaagaaacaagcttcaaccaggcgtacgggcgcgacctgatggaagcccaggagtggtgccgcaagtacatgaagtccggaaacgtgaaggatctgctgcaagcctgggatctgtactaccacgtgttcagaaggatctcaaaggctagcgccggcactggttcggatatctacatttgggcaccgctcgccggcacttgtggagtgctgttgctgtccctcgtgatcaccatgcataagaggggacggaagaagctgctgtacattttcaagcagccattcatgcggcctgtgcaaaccacccaggaggaggacgggtgcagctgccggttccctgaggaagaggagggcggatgcgaactgcgcgtgaagttcagccggagcgcagatgctcccgcataccaacagggacagaaccagctgtataacgagctgaacctgggcagaagggaagagtacgacgtcctcgacaagcggcggggacgcgacccagaaatgggaggaaagccccgccggaagaacccgcaggaaggcctgtacaacgagttgcagaaagacaagatggctgaagcttactcggagattggcatgaagggggagagaagaagagggaagggccacgacggcctttaccaaggactgagcactgccaccaaggacacctacgatgcgctgcacatgcaggccctgcccccgcggtccggttcgggcgcgactaacttcagcctgctgaagcaggccggagatgtggaggaaaaccctggaccgtccatggagactgataccctgcttctgtgggtcctgctcctctgggtgccgggctccaccggtgacatccagatgacccagaccacctcatccctgagcgcctctctgggtgatcgcgtgactatctcctgccgggcgtcgcaggatatctccaagtacctgaactggtaccagcaaaaaccggacgggaccgtgaaactgctgatctaccatacttcccgccttcattccggagtgccctcccggttttccggctcgggttcagggactgattattcgctgaccatttccaacctggagcaggaggacattgcgacctacttctgccaacaaggaaacaccctgccctacactttcggtggtggaaccaagctcgagatcaccggatcaacctcgggcagcgggaagccgggcagcggagagggatcgacgaaaggagaagtcaagctgcaggaatccggcccgggactggtggccccgagccagtcgctctccgtcacttgcaccgtgtcgggagtgtccttgcccgactacggagtgtcatggattcggcagccacctcgcaagggcctggaatggctcggcgtgatttggggctcagaaaccacatactacaacagcgccctgaagtctcggctcaccatcatcaaggacaattccaagtcccaagtgttcctgaagatgaatagcttgcagactgacgacaccgcgatctactactgtgccaagcactactactacggcggttcctacgccatggactactggggacaaggaacttccgtgactgtctcctcccctagggggggtggtggttcgggggtccaggtggaaaccatttcccccggcgacgggcgcaccttcccgaagcgcggacagacctgtgtggtgcactataccggaatgctcgaagatggaaagaagtttgacagctccagggaccgcaacaagcctttcaagtttatgcttggaaagcaggaagtcatccggggctgggaagagggagtcgcccagatgagcgtcggccagcgggccaagctgacgatctcccctgactatgcctacggcgctaccggccatcccggaatcattccgccgcacgcaaccctcgtgttcgacgtggaattgctcaagctggaaggcggccgcatggcgctgatagtgctcggcggagtggccggactgctgctgttcatcggcctgggcatcttcttctgcgtgagatgccgccatagaaggcggcaatga

SEQ ID NO: 69 - DNA, 7648 bp, Artificial Sequence
  pCVL-MND-CD8ss-DmrC-CD8TM-41BB-Zeta-P2A-IgKss-CD19scFv-DmrA-CD4TM codon optimized lentiviral vector
taacttttaaaagaaaaggggggattggggggtacagtgcaggggaaagaatagtagacataatagcaacagacatacaaactaaagaattacaaaaacaaattacaaaaattcaaaattttatcgattacgcgtgtacagagagacagcagaatatgggccaaacaggatatctgtggtaagcagttcctgccccggctcagggccaagaacagttggaacagcagaatatgggccaaacaggatatctgtggtaagcagttcctgccccggctcagggccaagaacagatggtccccagatgcggtcccgccctcagcagtttctagagaaccatcagatgtttccagggtgccccaaggacctgaaatgaccctgtgccttatttgaactaaccaatcagttcgcttctcgcttctgttcgcgcgcttctgctccccgagctctatataagcagagctcgtttagtgaaccgtcagatccctgcagggccgccaccatggccctccctgtgaccgccctgctgctccccctcgccctgttgctccatgctgcccgacctggatccatcctttggcacgagatgtggcacgagggactcgaagaagcgtcccggctgtacttcggagagcggaacgtgaaggggatgttcgaagtgctggaacccctgcacgccatgatggagcggggtcctcagacccttaaagaaacaagcttcaaccaggcgtacgggcgcgacctgatggaagcccaggagtggtgccgcaagtacatgaagtccggaaacgtgaaggatctgctgcaagcctgggatctgtactaccacgtgttcagaaggatctcaaaggctagcgccggcactggttcggatatctacatttgggcaccgctcgccggcacttgtggagtgctgttgctgtccctcgtgatcaccatgcataagaggggacggaagaagctgctgtacattttcaagcagccattcatgcggcctgtgcaaaccacccaggaggaggacgggtgcagctgccggttccctgaggaagaggagggcggatgcgaactgcgcgtgaagttcagccggagcgcagatgctcccgcataccaacagggacagaaccagctgtataacgagctgaacctgggcagaagggaagagtacgacgtcctcgacaagcggcggggacgcgacccagaaatgggaggaaagccccgccggaagaacccgcaggaaggcctgtacaacgagttgcagaaagacaagatggctgaagcttactcggagattggcatgaagggggagagaagaagagggaagggccacgacggcctttaccaaggactgagcactgccaccaaggacacctacgatgcgctgcacatgcaggccctgcccccgcggtccggttcgggcgcgactaacttcagcctgctgaagcaggccggagatgtggaggaaaaccctggaccgtccatggagactgataccctgcttctgtgggtcctgctcctctgggtgccgggctccaccggtgacatccagatgacccagaccacctcatccctgagcgcctctctgggtgatcgcgtgactatctcctgccgggcgtcgcaggatatctccaagtacctgaactggtaccagcaaaaaccggacgggaccgtgaaactgctgatctaccatacttcccgccttcattccggagtgccctcccggttttccggctcgggttcagggactgattattcgctgaccatttccaacctggagcaggaggacattgcgacctacttctgccaacaaggaaacaccctgccctacactttcggtggtggaaccaagctcgagatcaccggatcaacctcgggcagcgggaagccgggcagcggagagggatcgacgaaaggagaagtcaagctgcaggaatccggcccgggactggtggccccgagccagtcgctctccgtcacttgcaccgtgtcgggagtgtccttgcccgactacggagtgtcatggattcggcagccacctcgcaagggcctggaatggctcggcgtgatttggggctcagaaaccacatactacaacagcgccctgaagtctcggctcaccatcatcaaggacaattccaagtcccaagtgttcctgaagatgaatagcttgcagactgacgacaccgcgatctactactgtgccaagcactactactacggcggttcctacgccatggactactggggacaaggaacttccgtgactgtctcctcccctagggggggtggtggttcgggggtccaggtggaaaccatttcccccggcgacgggcgcaccttcccgaagcgcggacagacctgtgtggtgcactataccggaatgctcgaagatggaaagaagtttgacagctccagggaccgcaacaagcctttcaagtttatgcttggaaagcaggaagtcatccggggctgggaagagggagtcgcccagatgagcgtcggccagcgggccaagctgacgatctcccctgactatgcctacggcgctaccggccatcccggaatcattccgccgcacgcaaccctcgtgttcgacgtggaattgctcaagctggaaggcggccgcatggcgctgatagtgctcggcggagtggccggactgctgctgttcatcggcctgggcatcttcttctgcgtgagatgccgccatagaaggcggcaatgagtcgaccgagcatcttaccgccatttatacccatatttgttctgtttttcttgatttgggtatacatttaaatgttaatagaacaaaatggtggggcaatcatttacatttttagggatatgtaattactagttcaggtgtattgccacaagacaaacatgttaagaaactttcccgttatttacgctctgttcctgttaatcaacctctggattacaaaatttgtgaaagattgactgatattcttaactatgttgctccttttacgctgtgtggatatgctgctttatagcctctgtatctagctattgcttcccgtacggctttcgttttctcctccttgtataaatcctggttgctgtctcttttagaggagttgtggcccgttgtccgtcaacgtggcgtggtgtgctctgtgtttgctgacgcaacccccactggctggggcattgccaccacctgtcaactcctttctgggactttcgctttccccctcccgatcgccacggcagaactcatcgccgcctgccttgcccgctgctggacaggggctaggttgctgggcactgataattccgtggtgttgtcatcgaattcggtacctttttaaaagaaaaggggggactggaagggctaattcactcccaacgaagacaagatatcataacttcgtatagcatacattatacgaagttataatttatttgtgaaatttgtgatgctattgctttatttgtaaccatatgtttatttgtgaaatttgtgatgctattgctttatttgtaaccattgctttttgcttgtactgggtctctctggttagaccagatctgagcctgggagctctctggctaactagggaacccactgcttaagcctcaataaagcttgcctcgaccagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcctgcagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaatgaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcggt

SEQ ID NO: 70 - protein, 762 aa, Artificial Sequence
  SS-DmrC-CD8TM-41BB-CD3z-P2A-SS-CD123scFv-DmrA-CD4TM protein
MRPTWAWWLFLVLLLALWAPARGGSILWHEMWHEGLEEASRLYFGERNVKGMFEVLEPLHAMMERGPQTLKETSFNQAYGRDLMEAQEWCRKYMKSGNVKDLLQAWDLYYHVFRRISKASAGTGSDIYIWAPLAGTCGVLLLSLVITMHKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGGRSGSGATNFSLLKQAGDVEENPGPSLWWRLWWLLLLLLLLWPMVWAPRADYKDIVMTQSHKFMSTSVGDRVNITCKASQNVDSAVAWYQQKPGQSPKALIYSASYRYSGVPDRFTGRGSGTDFTLTISSVQAEDLAVYYCQQYYSTPWTFGGGTKLEIKRGGGGSGGGGSGGGGSGGGGSEVKLVESGGGLVQPGGSLSLSCAASGFTFTDYYMSWVRQPPGKALEWLALIRSKADGYTTEYSASVKGRFTLSRDDSQSILYLQMNALRPEDSATYYCARDAAYYSYYSPEGAMDYWGQGTSVTVSSSASGGGGSGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLEGGRMALIVLGGVAGLLLFIGLGIFFCVRCRHRRRQ

SEQ ID NO: 71 - DNA, 2289 bp, Artificial Sequence
  SS-DmrC-CD8TM-41BB-CD3z-P2A-SS-CD123scFv-DmrA-CD4TM DNA
atgcgccccacctgggcctggtggctgttcctggtgctgctgctggccctgtgggcacccgctcgcggcggatccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcctccaagcctgggacctctattatcatgtgttccgacgaatctcaaaggctagcgccggcactggttccgacatctacatctgggcccctctggccggcacatgtggcgtgctgctgctgagcctcgtgatcaccatgcataaacggggcagaaagaaactcctgtatatattcaaacaaccatttatgagaccagtacaaactactcaagaggaagatggctgtagctgccgatttccagaagaagaagaaggaggatgtgaactgcgggtgaagttcagcagaagcgccgacgcccctgcctaccagcagggccagaatcagctgtacaacgagctgaacctgggcagaagggaagagtacgacgtcctggataagcggagaggccgggaccctgagatgggcggcaagcctcggcggaagaacccccaggaaggcctgtataacgaactgcagaaagacaagatggccgaggcctacagcgagatcggcatgaagggcgagcggaggcggggcaagggccacgacggcctgtatcagggcctgtccaccgccaccaaggatacctacgacgccctgcacatgcaggccctgcccccaaggggcggccgctcaggatctggcgccacgaacttctctctgttaaagcaagcaggagatgttgaagaaaaccccgggccttcactgtggtggcgcctgtggtggctgctcctgcttctgttgctcctgtggcccatggtgtgggcccctagggcggactacaaagatattgtgatgacccagtctcacaaattcatgtccacatcagtaggagacagggtcaacatcacctgcaaggccagtcagaatgtggatagtgctgtagcctggtatcaacagaaaccagggcaatctcctaaagcactgatttactcggcatcctaccggtacagtggagtccctgatcgcttcacaggcaggggatctgggacagatttcactctcaccatcagcagtgtgcaggctgaagacctggcagtttattactgtcagcaatattatagcactccgtggacgttcggtggaggcaccaagctggaaatcaaacgtggtggtggtggttctggtggtggtggttctggcggcggcggctccggtggtggtggatccgaggtgaagctggtggagtctggaggaggcttggtacagcctgggggttctctgagtctctcctgtgcagcttctggattcaccttcactgattactacatgagctgggtccgccagcctccagggaaggcacttgagtggttggctttgattagaagcaaagctgatggttacacaacagaatacagtgcatctgtgaagggtcggttcaccctctccagagatgattcccaaagcatcctctatcttcaaatgaatgccctgagacctgaagacagtgccacttattactgtgcaagagatgcggcctactatagttactatagtcccgagggggctatggactactggggtcaaggaacctcagtcaccgtctcctcgagcgctagcggcggaggtgggagcggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaaggcggccgcatggccctgattgtgctggggggcgtcgccggcctcctgcttttcattgggctaggcatcttcttctgtgtcaggtgccggcaccgaaggcgccaataa

SEQ ID NO: 72 - DNA, 7717 bp, Artificial Sequence
  pCVL_MND-SS34-DmrC-CD8TM-41BB-CD3z-P2A-SS38-CD123scFv-DmrA-CD4TM lentiviral vector
gtacagagagacagcagaatatgggccaaacaggatatctgtggtaagcagttcctgccccggctcagggccaagaacagttggaacagcagaatatgggccaaacaggatatctgtggtaagcagttcctgccccggctcagggccaagaacagatggtccccagatgcggtcccgccctcagcagtttctagagaaccatcagatgtttccagggtgccccaaggacctgaaatgaccctgtgccttatttgaactaaccaatcagttcgcttctcgcttctgttcgcgcgcttctgctccccgagctctatataagcagagctcgtttagtgaaccgtcagatccctgcagggccgccaccatgcgccccacctgggcctggtggctgttcctggtgctgctgctggccctgtgggcacccgctcgcggcggatccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcctccaagcctgggacctctattatcatgtgttccgacgaatctcaaaggctagcgccggcactggttccgacatctacatctgggcccctctggccggcacatgtggcgtgctgctgctgagcctcgtgatcaccatgcataaacggggcagaaagaaactcctgtatatattcaaacaaccatttatgagaccagtacaaactactcaagaggaagatggctgtagctgccgatttccagaagaagaagaaggaggatgtgaactgcgggtgaagttcagcagaagcgccgacgcccctgcctaccagcagggccagaatcagctgtacaacgagctgaacctgggcagaagggaagagtacgacgtcctggataagcggagaggccgggaccctgagatgggcggcaagcctcggcggaagaacccccaggaaggcctgtataacgaactgcagaaagacaagatggccgaggcctacagcgagatcggcatgaagggcgagcggaggcggggcaagggccacgacggcctgtatcagggcctgtccaccgccaccaaggatacctacgacgccctgcacatgcaggccctgcccccaaggggcggccgctcaggatctggcgccacgaacttctctctgttaaagcaagcaggagatgttgaagaaaaccccgggccttcactgtggtggcgcctgtggtggctgctcctgcttctgttgctcctgtggcccatggtgtgggcccctagggcggactacaaagatattgtgatgacccagtctcacaaattcatgtccacatcagtaggagacagggtcaacatcacctgcaaggccagtcagaatgtggatagtgctgtagcctggtatcaacagaaaccagggcaatctcctaaagcactgatttactcggcatcctaccggtacagtggagtccctgatcgcttcacaggcaggggatctgggacagatttcactctcaccatcagcagtgtgcaggctgaagacctggcagtttattactgtcagcaatattatagcactccgtggacgttcggtggaggcaccaagctggaaatcaaacgtggtggtggtggttctggtggtggtggttctggcggcggcggctccggtggtggtggatccgaggtgaagctggtggagtctggaggaggcttggtacagcctgggggttctctgagtctctcctgtgcagcttctggattcaccttcactgattactacatgagctgggtccgccagcctccagggaaggcacttgagtggttggctttgattagaagcaaagctgatggttacacaacagaatacagtgcatctgtgaagggtcggttcaccctctccagagatgattcccaaagcatcctctatcttcaaatgaatgccctgagacctgaagacagtgccacttattactgtgcaagagatgcggcctactatagttactatagtcccgagggggctatggactactggggtcaaggaacctcagtcaccgtctcctcgagcgctagcggcggaggtgggagcggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaaggcggccgcatggccctgattgtgctggggggcgtcgccggcctcctgcttttcattgggctaggcatcttcttctgtgtcaggtgccggcaccgaaggcgccaataagtcgaccgagcatcttaccgccatttatacccatatttgttctgtttttcttgatttgggtatacatttaaatgttaatagaacaaaatggtggggcaatcatttacatttttagggatatgtaattactagttcaggtgtattgccacaagacaaacatgttaagaaactttcccgttatttacgctctgttcctgttaatcaacctctggattacaaaatttgtgaaagattgactgatattcttaactatgttgctccttttacgctgtgtggatatgctgctttatagcctctgtatctagctattgcttcccgtacggctttcgttttctcctccttgtataaatcctggttgctgtctcttttagaggagttgtggcccgttgtccgtcaacgtggcgtggtgtgctctgtgtttgctgacgcaacccccactggctggggcattgccaccacctgtcaactcctttctgggactttcgctttccccctcccgatcgccacggcagaactcatcgccgcctgccttgcccgctgctggacaggggctaggttgctgggcactgataattccgtggtgttgtcatcgaattcggtacctttttaaaagaaaaggggggactggaagggctaattcactcccaacgaagacaagatatcataacttcgtatagcatacattatacgaagttataatttatttgtgaaatttgtgatgctattgctttatttgtaaccatatgtttatttgtgaaatttgtgatgctattgctttatttgtaaccattgctttttgcttgtactgggtctctctggttagaccagatctgagcctgggagctctctggctaactagggaacccactgcttaagcctcaataaagcttgcctcgaccagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcctgcagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaatgaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcggttaacttttaaaagaaaaggggggattggggggtacagtgcaggggaaagaatagtagacataatagcaacagacatacaaactaaagaattacaaaaacaaattacaaaaattcaaaattttatcgattacgcgt

SEQ ID NO: 73 - DNA, 8230 bp, Artificial Sequence
  pBB_REV-CMV-IgKss-CD19scFv-DmrA-CD4TM_FOR-MND-CD8ss-DmrC-CD8TM-41 BB-CD3z lentiviral vector
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatcatatgccagcctatggtgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgggtctctctggttagaccagatctgagcctgggagctctctggctaactagggaacccactgcttaagcctcaataaagcttgccttgagtgctcaaagtagtgtgtgcccgtctgttgtgtgactctggtaactagagatccctcagacccttttagtcagtgtggaaaatctctagcagtggcgcccgaacagggacttgaaagcgaaagtaaagccagaggagatctctcgacgcaggactcggcttgctgaagcgcgcacggcaagaggcgaggggcggcgactggtgagtacgccaaaaattttgactagcggaggctagaaggagagagtagggtgcgagagcgtcggtattaagcgggggagaattagataaatgggaaaaaattcggttaaggccagggggaaagaaacaatataaactaaaacatatagttagggcaagcagggagctagaacgattcgcagttaatcctggccttttagagacatcagaaggctgtagacaaatactgggacagctacaaccatcccttcagacaggatcagaagaacttagatcattatataatacaatagcagtcctctattgtgtgcatcaaaggatagatgtaaaagacaccaaggaagccttagataagatagaggaagagcaaaacaaaagtaagaaaaaggcacagcaagcagcagctgacacaggaaacaacagccaggtcagccaaaattaccctatagtgcagaacctccaggggcaaatggtacatcaggccatatcacctagaactttaaattaagacagcagtacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggaaaggaccagcaaagctcctctggaaaggtgaaggggcagtagtaatacaagataatagtgacataaaagtagtgccaagaagaaaagcaaagatcatcagggattatggaaaacagatggcaggtgatgattgtgtggcaagtagacaggatgaggattaacacatggaaaagattagtaaaacaccatagctctagagcgatcccgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatcctcacacaaaaaaccaacacacagatgtctagtagctctgatcttttattctagcggccgcgtaccgaagctatcattgccgccttctatggcggcatctcacgcagaagaagatgcccaggccgatgaacagcagcagtccggccactccgccgagcactatcagcgccatgcggccgccttccagcttgagcaattccacgtcgaacacgagggttgcgtgcggcggaatgattccgggatggccggtagcgccgtaggcatagtcaggggagatcgtcagcttggcccgctggccgacgctcatctgggcgactccctcttcccagccccggatgacttcctgctttccaagcataaacttgaaaggcttgttgcggtccctggagctgtcaaacttctttccatcttcgagcattccggtatagtgcaccacacaggtctgtccgcgcttcgggaaggtgcgcccgtcgccgggggaaatggtttccacctggacccccgaaccaccaccccccctaggggaggagacagtcacggaagttccttgtccccagtagtccatggcgtaggaaccgccgtagtagtagtgcttggcacagtagtagatcgcggtgtcgtcagtctgcaagctattcatcttcaggaacacttgggacttggaattgtccttgatgatggtgagccgagacttcagggcgctgttgtagtatgtggtttctgagccccaaatcacgccgagccattccaggcccttgcgaggtggctgccgaatccatgacactccgtagtcgggcaaggacactcccgacacggtgcaagtgacggagagcgactggctcggggccaccagtcccgggccggattcctgcagcttgacttctcctttcgtcgatccctctccgctgcccggcttcccgctgcccgaggttgatccggtgatctcgagcttggttccaccaccgaaagtgtagggcagggtgtttccttgttggcagaagtaggtcgcaatgtcctcctgctccaggttggaaatggtcagcgaataatcagtccctgaacccgagccggaaaaccgggagggcactccggaatgaaggcgggaagtatggtagatcagcagtttcacggtcccgtccggtttttgctggtaccagttcaggtacttggagatatcctgcgacgcccggcaggagatagtcacgcgatcacccagagaggcgctcagggatgaggtggtctgggtcatctggatgtcaccggtggagcccggcacccagaggagcaggacccacagaagcagggtatcagtctccatggtggcacgcgccttgctagctagacaaaagtgttgtggaattgctccaggcgatctgacggttcactaaacgagctctgcttttataggcgcccaccgtacacgcctaagcgtcgacggaatgaaagaccccacctgtaggtttggcaagctaggatcaaggttaggaacagagagacagcagaatatgggccaaacaggatatctgtggtaagcagttcctgccccggctcagggccaagaacagttggaacagcagaatatgggccaaacaggatatctgtggtaagcagttcctgccccggctcagggccaagaacagatggtccccagatgcggtcccgccctcagcagtttctagagaaccatcagatgtttccagggtgccccaaggacctgaaatgaccctgtgccttatttgaactaaccaatcagttcgcttctcgcttctgttcgcgcgcttctgctccccgagctcaataaaagagcccacaacccctcactcggcgcgattcacctgacgcgtaccatggccctccctgtgaccgccctgctgctccccctcgccctgttgctccatgctgcccgacctggatccatcctttggcacgagatgtggcacgagggactcgaagaagcgtcccggctgtacttcggagagcggaacgtgaaggggatgttcgaagtgctggaacccctgcacgccatgatggagcggggtcctcagacccttaaagaaacaagcttcaaccaggcgtacgggcgcgacctgatggaagcccaggagtggtgccgcaagtacatgaagtccggaaacgtgaaggatctgctgcaagcctgggatctgtactaccacgtgttcagaaggatctcaaaggctagcgccggcactggttcggatatctacatttgggcaccgctcgccggcacttgtggagtgctgttgctgtccctcgtgatcaccatgcataagaggggacggaagaagctgctgtacattttcaagcagccattcatgcggcctgtgcaaaccacccaggaggaggacgggtgcagctgccggttccctgaggaagaggagggcggatgcgaactgcgcgtgaagttcagccggagcgcagatgctcccgcataccaacagggacagaaccagctgtataacgagctgaacctgggcagaagggaagagtacgacgtcctcgacaagcggcggggacgcgacccagaaatgggaggaaagccccgccggaagaacccgcaggaaggcctgtacaacgagttgcagaaagacaagatggctgaagcttactcggagattggcatgaagggggagagaagaagagggaagggccacgacggcctttaccaaggactgagcactgccaccaaggacacctacgatgcgctgcacatgcaggccctgcccccgcggtgaagcggccaactcgacgttattcccttcgaaggaaacctgcaggtacctttaagaccaatgacttacaaggcagctgtagatcttagccactttttaaaagaaaaggggggactggaagggctaattcactcccaaagaagacaagatctgctttttgcctgtactgggtctctctggttagaccagatctgagcctgggagctctctggctaactagggaacccactgcttaagcctcaataaagcttgccttgagtgcttcaatgtgtgtgttggttttttgtgtgtcgaaattctagcgattctagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggactagctttttgcaaaagcctaggcctccaaaaaagcctcctcactacttctggaatagctcagaggccgaggcggcctcggcctctgcataaataaaaaaaattagtcagccatggggcggagaatgggcggaactgggcggagttaggggcgggatgggcggagttaggggcgggactatggttgctgactaattgagatgagcttgcatgccgacattgattattgactagtccctaagaaaccattcttatcatgacattaacctataaaaataggcgtatcacgaggccctttcgtc

SEQ ID NO: 74 - DNA, 7135 bp, Artificial Sequence
  pCVL_sEF1a-CD123target-T2A-Puro lentiviral vector
aggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacacctgcagggccgccaccatggtcctcctttggctcacgctgctcctgatcgccctgccctgtctcctgcaaacgaaggaagatccaaacccaccaatcacgaacctaaggatgaaagcaaaggctcagcagttgacctgggaccttaacagaaatgtgaccgatatcgagtgtgttaaagacgccgactattctatgccggcagtgaacaatagctattgccagtttggagcaatttccttatgtgaagtgaccaactacaccgtccgagtggccaacccaccattctccacgtggatcctcttccctgagaacagtgggaagccttgggcaggtgcggagaatctgacctgctggattcatgacgtggatttcttgagctgcagctgggcggtaggcccgggggcccccgcggacgtccagtacgacctgtacttgaacgttgccaacaggcgtcaacagtacgagtgtcttcactacaaaacggatgctcagggaacacgtatcgggtgtcgtttcgatgacatctctcgactctccagcggttctcaaagttcccacatcctggtgcggggcaggagcgcagccttcggtatcccctgcacagataagtttgtcgtcttttcacagattgagatattaactccacccaacatgactgcaaagtgtaataagacacattcctttatgcactggaaaatgagaagtcatttcaatcgcaaatttcgctatgagcttcagatacaaaagagaatgcagcctgtaatcacagaacaggtcagagacagaacctccttccagctactcaatcctggaacgtacacagtacaaataagagcccgggaaagagtgtatgaattcttgagcgcctggagcaccccccagcgcttcgagtgcgaccaggaggagggcgcaaacacacgtgcctggcggacgtcgctgctgatcgcgctggggacgctgctggccctggtctgtgtcttcgtgatctgcagaaggtatctggtgatgcagagactctttccccgcatccctcacatgaaagaccccatcggtgacagcttccaaaacgacaagctggtggtctgggaggcgggcaaagccggcctggaggagtgtctggtgactgaagtacaggtcgtgcagaaaactggcggccgctccggtgagggcagaggaagtcttctaacatgcggtgacgtggaggagaatccgggcccctctagaaccgagtacaagcccacggtgcgcctcgccacccgcgacgacgtcccccgggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgccctcgagtgatgagagtcatcgtcgaccgagcatcttaccgccatttatacccatatttgttctgtttttcttgatttgggtatacatttaaatgttaatagaacaaaatggtggggcaatcatttacatttttagggatatgtaattactagttcaggtgtattgccacaagacaaacatgttaagaaactttcccgttatttacgctctgttcctgttaatcaacctctggattacaaaatttgtgaaagattgactgatattcttaactatgttgctccttttacgctgtgtggatatgctgctttatagcctctgtatctagctattgcttcccgtacggctttcgttttctcctccttgtataaatcctggttgctgtctcttttagaggagttgtggcccgttgtccgtcaacgtggcgtggtgtgctctgtgtttgctgacgcaacccccactggctggggcattgccaccacctgtcaactcctttctgggactttcgctttccccctcccgatcgccacggcagaactcatcgccgcctgccttgcccgctgctggacaggggctaggttgctgggcactgataattccgtggtgttgtcatcgaattcggtacctttttaaaagaaaaggggggactggaagggctaattcactcccaacgaagacaagatatcataacttcgtatagcatacattatacgaagttataatttatttgtgaaatttgtgatgctattgctttatttgtaaccatatgtttatttgtgaaatttgtgatgctattgctttatttgtaaccattgctttttgcttgtactgggtctctctggttagaccagatctgagcctgggagctctctggctaactagggaacccactgcttaagcctcaataaagcttgcctcgaccagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcctgcagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaatgaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcggttaacttttaaaagaaaaggggggattggggggtacagtgcaggggaaagaatagtagacataatagcaacagacatacaaactaaagaattacaaaaacaaattacaaaaattcaaaattttatcgattacgcgt

SEQ ID NO: 75 - DNA, 7735 bp, Artificial Sequence
  pCVL_MND-CD8ss-DmrC-CD3scFv-P2A-IgKss-CD19scFv-DmrA lentiviral vector
taacttttaaaagaaaaggggggattggggggtacagtgcaggggaaagaatagtagacataatagcaacagacatacaaactaaagaattacaaaaacaaattacaaaaattcaaaattttatcgattacgcgtgtacagagagacagcagaatatgggccaaacaggatatctgtggtaagcagttcctgccccggctcagggccaagaacagttggaacagcagaatatgggccaaacaggatatctgtggtaagcagttcctgccccggctcagggccaagaacagatggtccccagatgcggtcccgccctcagcagtttctagagaaccatcagatgtttccagggtgccccaaggacctgaaatgaccctgtgccttatttgaactaaccaatcagttcgcttctcgcttctgttcgcgcgcttctgctccccgagctctatataagcagagctcgtttagtgaaccgtcagatccctgcagggccgccaccatggccctccctgtgaccgccctgctgctccccctcgccctgttgctccatgctgcccgacctggatccatcctttggcacgagatgtggcacgagggactcgaagaagcgtcccggctgtacttcggagagcggaacgtgaaggggatgttcgaagtgctggaacccctgcacgccatgatggagcggggtcctcagacccttaaagaaacaagcttcaaccaggcgtacgggcgcgacctgatggaagcccaggagtggtgccgcaagtacatgaagtccggaaacgtgaaggatctgctgcaagcctgggatctgtactaccacgtgttcagaaggatctcaaaggctagccaggtgcaactggtgcagagcggcggtggcgttgtgcagccgggccgcagcctgcgcctgtcttgcaaagcgagcggctatacctttacgcgctataccatgcactgggtgcgccaggcgccgggcaaaggtctggaatggattggctatattaacccgtctcgcggctataccaactataatcagaaagtgaaagatcgctttaccattagccgcgataactctaaaaacaccgcgtttctgcagatggatagcctgcgcccggaagataccggcgtgtatttttgcgcgcgctactatgatgaccattatagcctggattattggggccagggcaccccggtgaccgttagctcgggcagcacaagcggcagcggcaagcctggatctggcgagggaagcaccaagggcgatatccagatgacccagagcccgagctctctgagcgcgagcgtgggcgatcgcgtgaccattacgtgcagcgcgtctagctctgtgagctatatgaactggtaccagcaaaccccaggcaaagcgccgaaacgctggatttatgataccagcaaactggcgagcggcgtgccgagccgctttagcggctctggtagcggcaccgattatacgtttaccattagctctctgcagccggaagatattgcgacctattactgccagcaatggagctctaacccgtttacctttggccagggtaccaaactgcagattacccgctccggttcgggcgcgactaacttcagcctgctgaagcaggccggagatgtggaggaaaaccctggaccgtccatggagactgataccctgcttctgtgggtcctgctcctctgggtgccgggctccaccggtgacatccagatgacccagaccacctcatccctgagcgcctctctgggtgatcgcgtgactatctcctgccgggcgtcgcaggatatctccaagtacctgaactggtaccagcaaaaaccggacgggaccgtgaaactgctgatctaccatacttcccgccttcattccggagtgccctcccggttttccggctcgggttcagggactgattattcgctgaccatttccaacctggagcaggaggacattgcgacctacttctgccaacaaggaaacaccctgccctacactttcggtggtggaaccaagctcgagatcaccggatcaacctcgggcagcgggaagccgggcagcggagagggatcgacgaaaggagaagtcaagctgcaggaatccggcccgggactggtggccccgagccagtcgctctccgtcacttgcaccgtgtcgggagtgtccttgcccgactacggagtgtcatggattcggcagccacctcgcaagggcctggaatggctcggcgtgatttggggctcagaaaccacatactacaacagcgccctgaagtctcggctcaccatcatcaaggacaattccaagtcccaagtgttcctgaagatgaatagcttgcagactgacgacaccgcgatctactactgtgccaagcactactactacggcggttcctacgccatggactactggggacaaggaacttccgtgactgtctcctcccctagggggggtggtggttcgggggtccaggtggaaaccatttcccccggcgacgggcgcaccttcccgaagcgcggacagacctgtgtggtgcactataccggaatgctcgaagatggaaagaagtttgacagctccagggaccgcaacaagcctttcaagtttatgcttggaaagcaggaagtcatccggggctgggaagagggagtcgcccagatgagcgtcggccagcgggccaagctgacgatctcccctgactatgcctacggcgctaccggccatcccggaatcattccgccgcacgcaaccctcgtgttcgacgtggaattgctcaagctggaatgaggcggccgcgtcgaccgagcatcttaccgccatttatacccatatttgttctgtttttcttgatttgggtatacatttaaatgttaatagaacaaaatggtggggcaatcatttacatttttagggatatgtaattactagttcaggtgtattgccacaagacaaacatgttaagaaactttcccgttatttacgctctgttcctgttaatcaacctctggattacaaaatttgtgaaagattgactgatattcttaactatgttgctccttttacgctgtgtggatatgctgctttatagcctctgtatctagctattgcttcccgtacggctttcgttttctcctccttgtataaatcctggttgctgtctcttttagaggagttgtggcccgttgtccgtcaacgtggcgtggtgtgctctgtgtttgctgacgcaacccccactggctggggcattgccaccacctgtcaactcctttctgggactttcgctttccccctcccgatcgccacggcagaactcatcgccgcctgccttgcccgctgctggacaggggctaggttgctgggcactgataattccgtggtgttgtcatcgaattcggtacctttttaaaagaaaaggggggactggaagggctaattcactcccaacgaagacaagatatcataacttcgtatagcatacattatacgaagttataatttatttgtgaaatttgtgatgctattgctttatttgtaaccatatgtttatttgtgaaatttgtgatgctattgctttatttgtaaccattgctttttgcttgtactgggtctctctggttagaccagatctgagcctgggagctctctggctaactagggaacccactgcttaagcctcaataaagcttgcctcgaccagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcctgcagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaatgaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcggt

SEQ ID NO: 76 - DNA, 8171 bp, Artificial Sequence
  pA.CD8ss.DmrC.CD8TM.41BB.Zeta.MND-scFV-DmrA.CD4TM lentiviral vector
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatcatatgccagcctatggtgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgggtctctctggttagaccagatctgagcctgggagctctctggctaactagggaacccactgcttaagcctcaataaagcttgccttgagtgctcaaagtagtgtgtgcccgtctgttgtgtgactctggtaactagagatccctcagacccttttagtcagtgtggaaaatctctagcagtggcgcccgaacagggacttgaaagcgaaagtaaagccagaggagatctctcgacgcaggactcggcttgctgaagcgcgcacggcaagaggcgaggggcggcgactggtgagtacgccaaaaattttgactagcggaggctagaaggagagagtagggtgcgagagcgtcggtattaagcgggggagaattagataaatgggaaaaaattcggttaaggccagggggaaagaaacaatataaactaaaacatatagttagggcaagcagggagctagaacgattcgcagttaatcctggccttttagagacatcagaaggctgtagacaaatactgggacagctacaaccatcccttcagacaggatcagaagaacttagatcattatataatacaatagcagtcctctattgtgtgcatcaaaggatagatgtaaaagacaccaaggaagccttagataagatagaggaagagcaaaacaaaagtaagaaaaaggcacagcaagcagcagctgacacaggaaacaacagccaggtcagccaaaattaccctatagtgcagaacctccaggggcaaatggtacatcaggccatatcacctagaactttaaattaagacagcagtacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggaaaggaccagcaaagctcctctggaaaggtgaaggggcagtagtaatacaagataatagtgacataaaagtagtgccaagaagaaaagcaaagatcatcagggattatggaaaacagatggcaggtgatgattgtgtggcaagtagacaggatgaggattaacacatggaaaagattagtaaaacaccatagctctagagcgatcccgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatcctcacacaaaaaaccaacacacagatgtctagtagctctgatcttttattctatcaccgcgggggcagggcctgcatgtgcagcgcatcgtaggtgtccttggtggcagtgctcagtccttggtaaaggccgtcgtggcccttccctcttcttctctcccccttcatgccaatctccgagtaagcttcagccatcttgtctttctgcaactcgttgtacaggccttcctgcgggttcttccggcggggctttcctcccatttctgggtcgcgtccccgccgcttgtcgaggacgtcgtactcttcccttctgcccaggttcagctcgttatacagctggttctgtccctgttggtatgcgggagcatctgcgctccggctgaacttcacgcgcagttcgcatccgccctcctcttcctcagggaaccggcagctgcacccgtcctcctcctgggtggtttgcacaggccgcatgaatggctgcttgaaaatgtacagcagcttcttccgtcccctcttatgcatggtgatcacgagggacagcaacagcactccacaagtgccggcgagcggtgcccaaatgtagatatccgaaccagtgccggcgaattcctttgagatccttctgaacacgtggtagtacagatcccaggcttgcagcagatccttcacgtttccggacttcatgtacttgcggcaccactcctgggcttccatcaggtcgcgcccgtacgcctggttgaagcttgtttctttaagggtctgaggaccccgctccatcatggcgtgcaggggttccagcacttcgaacatccccttcacgttccgctctccgaagtacagccgggacgcttcttcgagtccctcgtgccacatctcgtgccaaaggatgggcccaggtcgggcagcatggagcaacagggcgagggggagcagcagggcggtcacagggagggccatggtggcggccctgcaggctagacaaaagtgttgtggaattgctccaggcgatctgacggttcactaaacgagctctgcttttataggcgcccaccgtacacgcctaagcgtcgacggaatgaaagaccccacctgtaggtttggcaagctaggatcaaggttaggaacagagagacagcagaatatgggccaaacaggatatctgtggtaagcagttcctgccccggctcagggccaagaacagttggaacagcagaatatgggccaaacaggatatctgtggtaagcagttcctgccccggctcagggccaagaacagatggtccccagatgcggtcccgccctcagcagtttctagagaaccatcagatgtttccagggtgccccaaggacctgaaatgaccctgtgccttatttgaactaaccaatcagttcgcttctcgcttctgttcgcgcgcttctgctccccgagctcaataaaagagcccacaacccctcactcggcgcgattcacctgacgcgtgccaccatggagactgataccctgcttctgtgggtcctgctcctctgggtgccgggctccaccggtgacatccagatgacccagaccacctcatccctgagcgcctctctgggtgatcgcgtgactatctcctgccgggcgtcgcaggatatctccaagtacctgaactggtaccagcaaaaaccggacgggaccgtgaaactgctgatctaccatacttcccgccttcattccggagtgccctcccggttttccggctcgggttcagggactgattattcgctgaccatttccaacctggagcaggaggacattgcgacctacttctgccaacaaggaaacaccctgccctacactttcggtggtggaaccaagctcgagatcaccggatcaacctcgggcagcgggaagccgggcagcggagagggatcgacgaaaggagaagtcaagctgcaggaatccggcccgggactggtggccccgagccagtcgctctccgtcacttgcaccgtgtcgggagtgtccttgcccgactacggagtgtcatggattcggcagccacctcgcaagggcctggaatggctcggcgtgatttggggctcagaaaccacatactacaacagcgccctgaagtctcggctcaccatcatcaaggacaattccaagtcccaagtgttcctgaagatgaatagcttgcagactgacgacaccgcgatctactactgtgccaagcactactactacggcggttcctacgccatggactactggggacaaggaacttccgtgactgtctcctcccctagggggggtggtggttcgggggtccaggtggaaaccatttcccccggcgacgggcgcaccttcccgaagcgcggacagacctgtgtggtgcactataccggaatgctcgaagatggaaagaagtttgacagctccagggaccgcaacaagcctttcaagtttatgcttggaaagcaggaagtcatccggggctgggaagagggagtcgcccagatgagcgtcggccagcgggccaagctgacgatctcccctgactatgcctacggcgctaccggccatcccggaatcattccgccgcacgcaaccctcgtgttcgacgtggaattgctcaagctggaaggcggccgcatggcgctgatagtgctcggcggagtggccggactgctgctgttcatcggcctgggcatcttcttctgcgtgagatgccgccatagaaggcggcaatgaggcgcgcctttaagaccaatgacttacaaggcagctgtagatcttagccactttttaaaagaaaaggggggactggaagggctaattcactcccaaagaagacaagatctgctttttgcctgtactgggtctctctggttagaccagatctgagcctgggagctctctggctaactagggaacccactgcttaagcctcaataaagcttgccttgagtgcttcaatgtgtgtgttggttttttgtgtgtcgaaattctagcgattctagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggactagctttttgcaaaagcctaggcctccaaaaaagcctcctcactacttctggaatagctcagaggccgaggcggcctcggcctctgcataaataaaaaaaattagtcagccatggggcggagaatgggcggaactgggcggagttaggggcgggatgggcggagttaggggcgggactatggttgctgactaattgagatgagcttgcatgccgacattgattattgactagtccctaagaaaccattcttatcatgacattaacctataaaaataggcgtatcacgaggccctttcgtc

SEQ ID NO: 77 - DNA, 7639 bp, Artificial Sequence
  pCVL.MND.CD8ss.DmrC.CD8TM.41BB.Zeta.P2A.IgKss.CD19scFv.DmrA.CD154 TM.wPRE-Codon lentiviral vector
taacttttaaaagaaaaggggggattggggggtacagtgcaggggaaagaatagtagacataatagcaacagacatacaaactaaagaattacaaaaacaaattacaaaaattcaaaattttatcgattacgcgtgtacagagagacagcagaatatgggccaaacaggatatctgtggtaagcagttcctgccccggctcagggccaagaacagttggaacagcagaatatgggccaaacaggatatctgtggtaagcagttcctgccccggctcagggccaagaacagatggtccccagatgcggtcccgccctcagcagtttctagagaaccatcagatgtttccagggtgccccaaggacctgaaatgaccctgtgccttatttgaactaaccaatcagttcgcttctcgcttctgttcgcgcgcttctgctccccgagctctatataagcagagctcgtttagtgaaccgtcagatccctgcagggccgccaccatggccctccctgtgaccgccctgctgctccccctcgccctgttgctccatgctgcccgacctggatccatcctttggcacgagatgtggcacgagggactcgaagaagcgtcccggctgtacttcggagagcggaacgtgaaggggatgttcgaagtgctggaacccctgcacgccatgatggagcggggtcctcagacccttaaagaaacaagcttcaaccaggcgtacgggcgcgacctgatggaagcccaggagtggtgccgcaagtacatgaagtccggaaacgtgaaggatctgctgcaagcctgggatctgtactaccacgtgttcagaaggatctcaaaggctagcgccggcactggttcggatatctacatttgggcaccgctcgccggcacttgtggagtgctgttgctgtccctcgtgatcaccatgcataagaggggacggaagaagctgctgtacattttcaagcagccattcatgcggcctgtgcaaaccacccaggaggaggacgggtgcagctgccggttccctgaggaagaggagggcggatgcgaactgcgcgtgaagttcagccggagcgcagatgctcccgcataccaacagggacagaaccagctgtataacgagctgaacctgggcagaagggaagagtacgacgtcctcgacaagcggcggggacgcgacccagaaatgggaggaaagccccgccggaagaacccgcaggaaggcctgtacaacgagttgcagaaagacaagatggctgaagcttactcggagattggcatgaagggggagagaagaagagggaagggccacgacggcctttaccaaggactgagcactgccaccaaggacacctacgatgcgctgcacatgcaggccctgcccccgcggtccggttcgggcgcgactaacttcagcctgctgaagcaggccggagatgtggaggaaaaccctggaccgtccatggagactgataccctgcttctgtgggtcctgctcctctgggtgccgggctccaccggtgacatccagatgacccagaccacctcatccctgagcgcctctctgggtgatcgcgtgactatctcctgccgggcgtcgcaggatatctccaagtacctgaactggtaccagcaaaaaccggacgggaccgtgaaactgctgatctaccatacttcccgccttcattccggagtgccctcccggttttccggctcgggttcagggactgattattcgctgaccatttccaacctggagcaggaggacattgcgacctacttctgccaacaaggaaacaccctgccctacactttcggtggtggaaccaagctcgagatcaccggatcaacctcgggcagcgggaagccgggcagcggagagggatcgacgaaaggagaagtcaagctgcaggaatccggcccgggactggtggccccgagccagtcgctctccgtcacttgcaccgtgtcgggagtgtccttgcccgactacggagtgtcatggattcggcagccacctcgcaagggcctggaatggctcggcgtgatttggggctcagaaaccacatactacaacagcgccctgaagtctcggctcaccatcatcaaggacaattccaagtcccaagtgttcctgaagatgaatagcttgcagactgacgacaccgcgatctactactgtgccaagcactactactacggcggttcctacgccatggactactggggacaaggaacttccgtgactgtctcctcccctagggggggtggtggttcgggggtccaggtggaaaccatttcccccggcgacgggcgcaccttcccgaagcgcggacagacctgtgtggtgcactataccggaatgctcgaagatggaaagaagtttgacagctccagggaccgcaacaagcctttcaagtttatgcttggaaagcaggaagtcatccggggctgggaagagggagtcgcccagatgagcgtcggccagcgggccaagctgacgatctcccctgactatgcctacggcgctaccggccatcccggaatcattccgccgcacgcaaccctcgtgttcgacgtggaattgctcaagctggaaggcggccgcatgaagatcttcatgtacctgctgaccgtgttcctgatcacccagatgatcggcagcgccctgttcgccgtgtacctgcacaggaggtgagtcgaccgagcatcttaccgccatttatacccatatttgttctgtttttcttgatttgggtatacatttaaatgttaatagaacaaaatggtggggcaatcatttacatttttagggatatgtaattactagttcaggtgtattgccacaagacaaacatgttaagaaactttcccgttatttacgctctgttcctgttaatcaacctctggattacaaaatttgtgaaagattgactgatattcttaactatgttgctccttttacgctgtgtggatatgctgctttatagcctctgtatctagctattgcttcccgtacggctttcgttttctcctccttgtataaatcctggttgctgtctcttttagaggagttgtggcccgttgtccgtcaacgtggcgtggtgtgctctgtgtttgctgacgcaacccccactggctggggcattgccaccacctgtcaactcctttctgggactttcgctttccccctcccgatcgccacggcagaactcatcgccgcctgccttgcccgctgctggacaggggctaggttgctgggcactgataattccgtggtgttgtcatcgaattcggtacctttttaaaagaaaaggggggactggaagggctaattcactcccaacgaagacaagatatcataacttcgtatagcatacattatacgaagttataatttatttgtgaaatttgtgatgctattgctttatttgtaaccatatgtttatttgtgaaatttgtgatgctattgctttatttgtaaccattgctttttgcttgtactgggtctctctggttagaccagatctgagcctgggagctctctggctaactagggaacccactgcttaagcctcaataaagcttgcctcgaccagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcctgcagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaatgaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcggt

SEQ ID NO: 78 - protein, 736 aa, Artificial Sequence
  CD8ss.DmrC.CD8TM.41BB.Zeta.P2A.IgKss.CD19scFv.DmrA.CD154TM codon optimized protein
MALPVTALLLPLALLLHAARPGSILWHEMWHEGLEEASRLYFGERNVKGMFEVLEPLHAMMERGPQTLKETSFNQAYGRDLMEAQEWCRKYMKSGNVKDLLQAWDLYYHVFRRISKASAGTGSDIYIWAPLAGTCGVLLLSLVITMHKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSGSGATNFSLLKQAGDVEENPGPSMETDTLLLWVLLLWVPGSTGDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSPRGGGGSGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLEGGRMKIFMYLLTVFLITQMIGSALFAVYLHRR

SEQ ID NO: 79 - DNA, 7231 bp, Artificial Sequence
  pCVL.MND.CD8ss.DmrC.CD8hinge-TM.41BB.Zeta.T2A.1.mTagBFP.wPRE lentiviral vector
gtacagagagacagcagaatatgggccaaacaggatatctgtggtaagcagttcctgccccggctcagggccaagaacagttggaacagcagaatatgggccaaacaggatatctgtggtaagcagttcctgccccggctcagggccaagaacagatggtccccagatgcggtcccgccctcagcagtttctagagaaccatcagatgtttccagggtgccccaaggacctgaaatgaccctgtgccttatttgaactaaccaatcagttcgcttctcgcttctgttcgcgcgcttctgctccccgagctctatataagcagagctcgtttagtgaaccgtcagatccctgcagggccgccaccatggccctccctgtgaccgccctgctgctccccctcgccctgttgctccatgctgcccgacctggatccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcctccaagcctgggacctctattatcatgtgttccgacgaatctcaaaggctagcgccaagcctaccaccacccctgcccctagacctccaacacccgccccaacaatcgccagccagcctctgtctctgaggcccgaggcttgtagaccagctgctggcggagccgtacacaccagaggactggatttcgcctgcgacatctacatctgggcccctctggccggcacatgtggcgtgctgctgctgagcctcgtgatcaccatgcataaacggggcagaaagaaactcctgtatatattcaaacaaccatttatgagaccagtacaaactactcaagaggaagatggctgtagctgccgatttccagaagaagaagaaggaggatgtgaactgcgggtgaagttcagcagaagcgccgacgcccctgcctaccagcagggccagaatcagctgtacaacgagctgaacctgggcagaagggaagagtacgacgtcctggataagcggagaggccgggaccctgagatgggcggcaagcctcggcggaagaacccccaggaaggcctgtataacgaactgcagaaagacaagatggccgaggcctacagcgagatcggcatgaagggcgagcggaggcggggcaagggccacgacggcctgtatcagggcctgtccaccgccaccaaggatacctacgacgccctgcacatgcaggccctgcccccaaggggcggccgctccggtgagggcagaggaagtcttctaacatgcggtgacgtggaggagaatccgggcccctctagaagcgagctgattaaggagaacatgcacatgaagctgtacatggagggcaccgtggacaaccatcacttcaagtgcacatccgagggcgaaggcaagccctacgagggcacccagaccatgagaatcaaggtggtcgagggcggccctctccccttcgccttcgacatcctggctactagcttcctctacggcagcaagaccttcatcaaccacacccagggcatccccgacttcttcaagcagtccttccctgagggcttcacatgggagagagtcaccacatacgaagacgggggcgtgctgaccgctacccaggacaccagcctccaggacggctgcctcatctacaacgtcaagatcagaggggtgaacttcacatccaacggccctgtgatgcagaagaaaacactcggctgggaggccttcaccgagacgctgtaccccgctgacggcggcctggaaggcagaaacgacatggccctgaagctcgtgggcgggagccatctgatcgcaaacatcaagaccacatatagatccaagaaacccgctaagaacctcaagatgcctggcgtctactatgtggactacagactggaaagaatcaaggaggccaacaacgagacctacgtcgagcagcacgaggtggcagtggccagatactgcgacctccctagcaaactggggcacaagcttaattgagtcgaccgagcatcttaccgccatttatacccatatttgttctgtttttcttgatttgggtatacatttaaatgttaatagaacaaaatggtggggcaatcatttacatttttagggatatgtaattactagttcaggtgtattgccacaagacaaacatgttaagaaactttcccgttatttacgctctgttcctgttaatcaacctctggattacaaaatttgtgaaagattgactgatattcttaactatgttgctccttttacgctgtgtggatatgctgctttatagcctctgtatctagctattgcttcccgtacggctttcgttttctcctccttgtataaatcctggttgctgtctcttttagaggagttgtggcccgttgtccgtcaacgtggcgtggtgtgctctgtgtttgctgacgcaacccccactggctggggcattgccaccacctgtcaactcctttctgggactttcgctttccccctcccgatcgccacggcagaactcatcgccgcctgccttgcccgctgctggacaggggctaggttgctgggcactgataattccgtggtgttgtcatcgaattcggtacctttttaaaagaaaaggggggactggaagggctaattcactcccaacgaagacaagatatcataacttcgtatagcatacattatacgaagttataatttatttgtgaaatttgtgatgctattgctttatttgtaaccatatgtttatttgtgaaatttgtgatgctattgctttatttgtaaccattgctttttgcttgtactgggtctctctggttagaccagatctgagcctgggagctctctggctaactagggaacccactgcttaagcctcaataaagcttgcctcgaccagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcctgcagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaatgaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcggttaacttttaaaagaaaaggggggattggggggtacagtgcaggggaaagaatagtagacataatagcaacagacatacaaactaaagaattacaaaaacaaattacaaaaattcaaaattttatcgattacgcgt

SEQ ID NO: 80 - protein, 343 aa, Artificial Sequene
  CD8ss.DmrC.CD8hinge-TM.41BB.Zeta protein
MALPVTALLLPLALLLHAARPGSILWHEMWHEGLEEASRLYFGERNVKGMFEVLEPLHAMMERGPQTLKETSFNQAYGRDLMEAQEWCRKYMKSGNVKDLLQAWDLYYHVFRRISKASAKPTTTPAPRPPTPAPTIASQPLSLRPEACRPAAGGAVHTRGLDFACDIYIWAPLAGTCGVLLLSLVITMHKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 81 - DNA, 7264 bp, Artificial Sequence
  pCVL.sEF1a.T7.hScnSS.CD19scFv.DmrA.T2A.1.mCherry.wPRE lentiviral vector
aggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacacctgcaggtaatacgactcactatagggtccactgccgccaccatgcccctgggcctgctgtggctgggcctggccctgctgggcgccctgcacgcccaggccggatccgatatccagatgacccagaccaccagcagcctgagcgccagcctgggcgatagagtgaccatcagctgcagagccagccaggacatcagcaagtacctgaactggtatcagcagaaacccgacggcaccgtgaagctgctgatctaccacaccagcagactgcacagcggcgtgcccagcagattttctggcagcggctccggcaccgactacagcctgaccatctccaacctggaacaggaagatatcgctacctacttctgtcagcaaggcaacaccctgccctacaccttcggcggaggcaccaagctggaaatcaccggcagcacaagcggcagcggcaagcctggatctggcgagggaagcaccaagggcgaagtgaaactgcaggaaagcggccctggactggtggccccaagccagtctctgagcgtgacctgtaccgtgtccggcgtgtccctgcctgactatggcgtgtcctggatcagacagccacccagaaagggcctggaatggctgggagtgatctggggcagcgagacaacctactacaacagcgccctgaagtcccggctgaccatcatcaaggacaactccaagagccaggtgttcctgaagatgaacagcctgcagaccgacgacaccgccatctactactgcgccaagcactactactacggcggcagctacgccatggactactggggccagggcacaagcgtgaccgtgtccagcgctagcggcggaggtgggagcggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaaggcggccgctccggtgagggcagaggaagtcttctaacatgcggtgacgtggaggagaatccgggcccctctagagtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctctctgcaggacggcgagttcatctacaaggtgaagctgcgcggcaccaacttcccctccgacggccccgtaatgcagaagaagactatgggctgggaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagtaagtcgaccgagcatcttaccgccatttatacccatatttgttctgtttttcttgatttgggtatacatttaaatgttaatagaacaaaatggtggggcaatcatttacatttttagggatatgtaattactagttcaggtgtattgccacaagacaaacatgttaagaaactttcccgttatttacgctctgttcctgttaatcaacctctggattacaaaatttgtgaaagattgactgatattcttaactatgttgctccttttacgctgtgtggatatgctgctttatagcctctgtatctagctattgcttcccgtacggctttcgttttctcctccttgtataaatcctggttgctgtctcttttagaggagttgtggcccgttgtccgtcaacgtggcgtggtgtgctctgtgtttgctgacgcaacccccactggctggggcattgccaccacctgtcaactcctttctgggactttcgctttccccctcccgatcgccacggcagaactcatcgccgcctgccttgcccgctgctggacaggggctaggttgctgggcactgataattccgtggtgttgtcatcgaattcggtacctttttaaaagaaaaggggggactggaagggctaattcactcccaacgaagacaagatatcataacttcgtatagcatacattatacgaagttataatttatttgtgaaatttgtgatgctattgctttatttgtaaccatatgtttatttgtgaaatttgtgatgctattgctttatttgtaaccattgctttttgcttgtactgggtctctctggttagaccagatctgagcctgggagctctctggctaactagggaacccactgcttaagcctcaataaagcttgcctcgaccagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcctgcagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaatgaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcggttaacttttaaaagaaaaggggggattggggggtacagtgcaggggaaagaatagtagacataatagcaacagacatacaaactaaagaattacaaaaacaaattacaaaaattcaaaattttatcgattacgcgt

SEQ ID NO: 82 - protein, 382 aa, Artificial Sequence
  hScnSS.CD19scFv.DmrA protein
MPLGLLWLGLALLGALHAQAGSDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSASGGGGSGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLEG

SEQ ID NO: 83 - DNA, 7267 bp, Artificial Sequence
  pCVL.sEF1a.T7.hScnSS.CD20scFv.DmrA.T2A.1.mCherry.wPRE lentiviral vector
aggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacacctgcaggtaatacgactcactatagggtccactgccgccaccatgcccctgggcctgctgtggctgggcctggccctgctgggcgccctgcacgcccaggccggatccgaggttcaactgcaacagtctggggcagaactcgtcaagccaggtgcctccgtaaagatgtcttgcaaggcttctggctacacatttaccagctacaatatgcactgggtgaaacagacacctggacagggcctggagtggattggagccatttatcctggaaatggtgatacttcctacaatcagaagttcaaaggcaaggccacattgactgccgacaaatcttcgagtacagcctacatgcaactcagcagcctgacatctgaggactctgcggactattactgcgccagatccaactactacggtagtagttactggttcttcgatgtctggggcgcagggaccactgtgaccgtctcatcgggcagtacaagcggtggtggctccgggggcggttcaggtgggggcggcagcagcgacattgtgctgacccaatccccagctatcctgtctgcatcgccgggcgagaaggtcacaatgacttgcagggccagctcaagtgtaaattacatggactggtaccagaagaagccagggtcctctcccaaaccctggatctacgccacctccaacctggcttctggagtgcctgcccgcttcagtggcagtgggtctgggacctcttactctctcacaatcagcagagtggaggctgaagatgctgcgacttattactgccagcagtggagtttcaacccacccacgttcggaggcggtaccaagctggagatcaaggctagcggcggaggtgggagcggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaaggcggccgctccggtgagggcagaggaagtcttctaacatgcggtgacgtggaggagaatccgggcccctctagagtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctctctgcaggacggcgagttcatctacaaggtgaagctgcgcggcaccaacttcccctccgacggccccgtaatgcagaagaagactatgggctgggaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagtaagtcgaccgagcatcttaccgccatttatacccatatttgttctgtttttcttgatttgggtatacatttaaatgttaatagaacaaaatggtggggcaatcatttacatttttagggatatgtaattactagttcaggtgtattgccacaagacaaacatgttaagaaactttcccgttatttacgctctgttcctgttaatcaacctctggattacaaaatttgtgaaagattgactgatattcttaactatgttgctccttttacgctgtgtggatatgctgctttatagcctctgtatctagctattgcttcccgtacggctttcgttttctcctccttgtataaatcctggttgctgtctcttttagaggagttgtggcccgttgtccgtcaacgtggcgtggtgtgctctgtgtttgctgacgcaacccccactggctggggcattgccaccacctgtcaactcctttctgggactttcgctttccccctcccgatcgccacggcagaactcatcgccgcctgccttgcccgctgctggacaggggctaggttgctgggcactgataattccgtggtgttgtcatcgaattcggtacctttttaaaagaaaaggggggactggaagggctaattcactcccaacgaagacaagatatcataacttcgtatagcatacattatacgaagttataatttatttgtgaaatttgtgatgctattgctttatttgtaaccatatgtttatttgtgaaatttgtgatgctattgctttatttgtaaccattgctttttgcttgtactgggtctctctggttagaccagatctgagcctgggagctctctggctaactagggaacccactgcttaagcctcaataaagcttgcctcgaccagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcctgcagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaatgaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcggttaacttttaaaagaaaaggggggattggggggtacagtgcaggggaaagaatagtagacataatagcaacagacatacaaactaaagaattacaaaaacaaattacaaaaattcaaaattttatcgattacgcgt

SEQ ID NO: 84 - protein, 383 aa, Artificial Sequence
  hScnSS.CD20scFv.DmrA protein
MPLGLLWLGLALLGALHAQAGSEVQLQQSGAELVKPGASVKMSCKASGYTFTSYNMHWVKQTPGQGLEWIGAIYPGNGDTSYNQKFKGKATLTADKSSSTAYMQLSSLTSEDSADYYCARSNYYGSSYWFFDVWGAGTTVTVSSGSTSGGGSGGGSGGGGSSDIVLTQSPAILSASPGEKVTMTCRASSSVNYMDWYQKKPGSSPKPWIYATSNLASGVPARFSGSGSGTSYSLTISRVEAEDAATYYCQQWSFNPPTFGGGTKLEIKASGGGGSGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLEG

SEQ ID NO: 85 - DNA, 7648 bp, Artificial Sequence
  pCVL.MND.CD8ss.FRB.CD8TM.41BB.Zeta.P2A.IgKss.CD19scFv.DmrA.CD4TM. wPRE-Codon lentiviral vector
taacttttaaaagaaaaggggggattggggggtacagtgcaggggaaagaatagtagacataatagcaacagacatacaaactaaagaattacaaaaacaaattacaaaaattcaaaattttatcgattacgcgtgtacagagagacagcagaatatgggccaaacaggatatctgtggtaagcagttcctgccccggctcagggccaagaacagttggaacagcagaatatgggccaaacaggatatctgtggtaagcagttcctgccccggctcagggccaagaacagatggtccccagatgcggtcccgccctcagcagtttctagagaaccatcagatgtttccagggtgccccaaggacctgaaatgaccctgtgccttatttgaactaaccaatcagttcgcttctcgcttctgttcgcgcgcttctgctccccgagctctatataagcagagctcgtttagtgaaccgtcagatccctgcagggccgccaccatggccctccctgtgaccgccctgctgctccccctcgccctgttgctccatgctgcccgacctggatccatcctttggcacgagatgtggcacgagggactcgaagaagcgtcccggctgtacttcggagagcggaacgtgaaggggatgttcgaagtgctggaacccctgcacgccatgatggagcggggtcctcagacccttaaagaaacaagcttcaaccaggcgtacgggcgcgacctgatggaagcccaggagtggtgccgcaagtacatgaagtccggaaacgtgaaggatctgacccaagcctgggatctgtactaccacgtgttcagaaggatctcaaaggctagcgccggcactggttcggatatctacatttgggcaccgctcgccggcacttgtggagtgctgttgctgtccctcgtgatcaccatgcataagaggggacggaagaagctgctgtacattttcaagcagccattcatgcggcctgtgcaaaccacccaggaggaggacgggtgcagctgccggttccctgaggaagaggagggcggatgcgaactgcgcgtgaagttcagccggagcgcagatgctcccgcataccaacagggacagaaccagctgtataacgagctgaacctgggcagaagggaagagtacgacgtcctcgacaagcggcggggacgcgacccagaaatgggaggaaagccccgccggaagaacccgcaggaaggcctgtacaacgagttgcagaaagacaagatggctgaagcttactcggagattggcatgaagggggagagaagaagagggaagggccacgacggcctttaccaaggactgagcactgccaccaaggacacctacgatgcgctgcacatgcaggccctgcccccgcggtccggttcgggcgcgactaacttcagcctgctgaagcaggccggagatgtggaggaaaaccctggaccgtccatggagactgataccctgcttctgtgggtcctgctcctctgggtgccgggctccaccggtgacatccagatgacccagaccacctcatccctgagcgcctctctgggtgatcgcgtgactatctcctgccgggcgtcgcaggatatctccaagtacctgaactggtaccagcaaaaaccggacgggaccgtgaaactgctgatctaccatacttcccgccttcattccggagtgccctcccggttttccggctcgggttcagggactgattattcgctgaccatttccaacctggagcaggaggacattgcgacctacttctgccaacaaggaaacaccctgccctacactttcggtggtggaaccaagctcgagatcaccggatcaacctcgggcagcgggaagccgggcagcggagagggatcgacgaaaggagaagtcaagctgcaggaatccggcccgggactggtggccccgagccagtcgctctccgtcacttgcaccgtgtcgggagtgtccttgcccgactacggagtgtcatggattcggcagccacctcgcaagggcctggaatggctcggcgtgatttggggctcagaaaccacatactacaacagcgccctgaagtctcggctcaccatcatcaaggacaattccaagtcccaagtgttcctgaagatgaatagcttgcagactgacgacaccgcgatctactactgtgccaagcactactactacggcggttcctacgccatggactactggggacaaggaacttccgtgactgtctcctcccctagggggggtggtggttcgggggtccaggtggaaaccatttcccccggcgacgggcgcaccttcccgaagcgcggacagacctgtgtggtgcactataccggaatgctcgaagatggaaagaagtttgacagctccagggaccgcaacaagcctttcaagtttatgcttggaaagcaggaagtcatccggggctgggaagagggagtcgcccagatgagcgtcggccagcgggccaagctgacgatctcccctgactatgcctacggcgctaccggccatcccggaatcattccgccgcacgcaaccctcgtgttcgacgtggaattgctcaagctggaaggcggccgcatggcgctgatagtgctcggcggagtggccggactgctgctgttcatcggcctgggcatcttcttctgcgtgagatgccgccatagaaggcggcaatgagtcgaccgagcatcttaccgccatttatacccatatttgttctgtttttcttgatttgggtatacatttaaatgttaatagaacaaaatggtggggcaatcatttacatttttagggatatgtaattactagttcaggtgtattgccacaagacaaacatgttaagaaactttcccgttatttacgctctgttcctgttaatcaacctctggattacaaaatttgtgaaagattgactgatattcttaactatgttgctccttttacgctgtgtggatatgctgctttatagcctctgtatctagctattgcttcccgtacggctttcgttttctcctccttgtataaatcctggttgctgtctcttttagaggagttgtggcccgttgtccgtcaacgtggcgtggtgtgctctgtgtttgctgacgcaacccccactggctggggcattgccaccacctgtcaactcctttctgggactttcgctttccccctcccgatcgccacggcagaactcatcgccgcctgccttgcccgctgctggacaggggctaggttgctgggcactgataattccgtggtgttgtcatcgaattcggtacctttttaaaagaaaaggggggactggaagggctaattcactcccaacgaagacaagatatcataacttcgtatagcatacattatacgaagttataatttatttgtgaaatttgtgatgctattgctttatttgtaaccatatgtttatttgtgaaatttgtgatgctattgctttatttgtaaccattgctttttgcttgtactgggtctctctggttagaccagatctgagcctgggagctctctggctaactagggaacccactgcttaagcctcaataaagcttgcctcgaccagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcctgcagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaatgaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcggt

SEQ ID NO: 86 - protein, 739 aa, Artificial Sequence
  CD8ss.FRB.CD8TM.41BB.Zeta.P2A.IgKss.CD19scFv.DmrA.CD4TM codon optimized protein
MALPVTALLLPLALLLHAARPGSILWHEMWHEGLEEASRLYFGERNVKGMFEVLEPLHAMMERGPQTLKETSFNQAYGRDLMEAQEWCRKYMKSGNVKDLTQAWDLYYHVFRRISKASAGTGSDIYIWAPLAGTCGVLLLSLVITMHKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSGSGATNFSLLKQAGDVEENPGPSMETDTLLLWVLLLWVPGSTGDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSPRGGGGSGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLEGGRMALIVLGGVAGLLLFIGLGIFFCVRCRHRRRQ

SEQ ID NO: 87 - DNA, 7639 bp, Artificial Sequence
  pCVL.MND.CD8ss.FRB.CD8TM.41BB.Zeta.P2A.IgKss.CD19scFv.DmrA.CD154T M.wPRE-Codon lentiviral vector
taacttttaaaagaaaaggggggattggggggtacagtgcaggggaaagaatagtagacataatagcaacagacatacaaactaaagaattacaaaaacaaattacaaaaattcaaaattttatcgattacgcgtgtacagagagacagcagaatatgggccaaacaggatatctgtggtaagcagttcctgccccggctcagggccaagaacagttggaacagcagaatatgggccaaacaggatatctgtggtaagcagttcctgccccggctcagggccaagaacagatggtccccagatgcggtcccgccctcagcagtttctagagaaccatcagatgtttccagggtgccccaaggacctgaaatgaccctgtgccttatttgaactaaccaatcagttcgcttctcgcttctgttcgcgcgcttctgctccccgagctctatataagcagagctcgtttagtgaaccgtcagatccctgcagggccgccaccatggccctccctgtgaccgccctgctgctccccctcgccctgttgctccatgctgcccgacctggatccatcctttggcacgagatgtggcacgagggactcgaagaagcgtcccggctgtacttcggagagcggaacgtgaaggggatgttcgaagtgctggaacccctgcacgccatgatggagcggggtcctcagacccttaaagaaacaagcttcaaccaggcgtacgggcgcgacctgatggaagcccaggagtggtgccgcaagtacatgaagtccggaaacgtgaaggatctgacccaagcctgggatctgtactaccacgtgttcagaaggatctcaaaggctagcgccggcactggttcggatatctacatttgggcaccgctcgccggcacttgtggagtgctgttgctgtccctcgtgatcaccatgcataagaggggacggaagaagctgctgtacattttcaagcagccattcatgcggcctgtgcaaaccacccaggaggaggacgggtgcagctgccggttccctgaggaagaggagggcggatgcgaactgcgcgtgaagttcagccggagcgcagatgctcccgcataccaacagggacagaaccagctgtataacgagctgaacctgggcagaagggaagagtacgacgtcctcgacaagcggcggggacgcgacccagaaatgggaggaaagccccgccggaagaacccgcaggaaggcctgtacaacgagttgcagaaagacaagatggctgaagcttactcggagattggcatgaagggggagagaagaagagggaagggccacgacggcctttaccaaggactgagcactgccaccaaggacacctacgatgcgctgcacatgcaggccctgcccccgcggtccggttcgggcgcgactaacttcagcctgctgaagcaggccggagatgtggaggaaaaccctggaccgtccatggagactgataccctgcttctgtgggtcctgctcctctgggtgccgggctccaccggtgacatccagatgacccagaccacctcatccctgagcgcctctctgggtgatcgcgtgactatctcctgccgggcgtcgcaggatatctccaagtacctgaactggtaccagcaaaaaccggacgggaccgtgaaactgctgatctaccatacttcccgccttcattccggagtgccctcccggttttccggctcgggttcagggactgattattcgctgaccatttccaacctggagcaggaggacattgcgacctacttctgccaacaaggaaacaccctgccctacactttcggtggtggaaccaagctcgagatcaccggatcaacctcgggcagcgggaagccgggcagcggagagggatcgacgaaaggagaagtcaagctgcaggaatccggcccgggactggtggccccgagccagtcgctctccgtcacttgcaccgtgtcgggagtgtccttgcccgactacggagtgtcatggattcggcagccacctcgcaagggcctggaatggctcggcgtgatttggggctcagaaaccacatactacaacagcgccctgaagtctcggctcaccatcatcaaggacaattccaagtcccaagtgttcctgaagatgaatagcttgcagactgacgacaccgcgatctactactgtgccaagcactactactacggcggttcctacgccatggactactggggacaaggaacttccgtgactgtctcctcccctagggggggtggtggttcgggggtccaggtggaaaccatttcccccggcgacgggcgcaccttcccgaagcgcggacagacctgtgtggtgcactataccggaatgctcgaagatggaaagaagtttgacagctccagggaccgcaacaagcctttcaagtttatgcttggaaagcaggaagtcatccggggctgggaagagggagtcgcccagatgagcgtcggccagcgggccaagctgacgatctcccctgactatgcctacggcgctaccggccatcccggaatcattccgccgcacgcaaccctcgtgttcgacgtggaattgctcaagctggaaggcggccgcatgaagatcttcatgtacctgctgaccgtgttcctgatcacccagatgatcggcagcgccctgttcgccgtgtacctgcacaggaggtgagtcgaccgagcatcttaccgccatttatacccatatttgttctgtttttcttgatttgggtatacatttaaatgttaatagaacaaaatggtggggcaatcatttacatttttagggatatgtaattactagttcaggtgtattgccacaagacaaacatgttaagaaactttcccgttatttacgctctgttcctgttaatcaacctctggattacaaaatttgtgaaagattgactgatattcttaactatgttgctccttttacgctgtgtggatatgctgctttatagcctctgtatctagctattgcttcccgtacggctttcgttttctcctccttgtataaatcctggttgctgtctcttttagaggagttgtggcccgttgtccgtcaacgtggcgtggtgtgctctgtgtttgctgacgcaacccccactggctggggcattgccaccacctgtcaactcctttctgggactttcgctttccccctcccgatcgccacggcagaactcatcgccgcctgccttgcccgctgctggacaggggctaggttgctgggcactgataattccgtggtgttgtcatcgaattcggtacctttttaaaagaaaaggggggactggaagggctaattcactcccaacgaagacaagatatcataacttcgtatagcatacattatacgaagttataatttatttgtgaaatttgtgatgctattgctttatttgtaaccatatgtttatttgtgaaatttgtgatgctattgctttatttgtaaccattgctttttgcttgtactgggtctctctggttagaccagatctgagcctgggagctctctggctaactagggaacccactgcttaagcctcaataaagcttgcctcgaccagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcctgcagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaatgaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcggt

SEQ ID NO: 88 - protein, 736 aa, Artificial Sequence
  CD8ss.FRB.CD8TM.41BB.Zeta.P2A.IgKss.CD19scFv.DmrA.CD154TM codon optimized protein
MALPVTALLLPLALLLHAARPGSILWHEMWHEGLEEASRLYFGERNVKGMFEVLEPLHAMMERGPQTLKETSFNQAYGRDLMEAQEWCRKYMKSGNVKDLTQAWDLYYHVFRRISKASAGTGSDIYIWAPLAGTCGVLLLSLVITMHKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSGSGATNFSLLKQAGDVEENPGPSMETDTLLLWVLLLWVPGSTGDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSPRGGGGSGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLEGGRMKIFMYLLTVFLITQMIGSALFAVYLHRR

SEQ ID NO: 89 - DNA, 7765 bp, Artificial Sequence
  pCVL.MND.CD8ss.FRB.CD8hinge-TM.41BB.Zeta.P2A.IgKss.CD19scFv.DmrA. CD154TM.wPRE-Codon lentiviral vector
taacttttaaaagaaaaggggggattggggggtacagtgcaggggaaagaatagtagacataatagcaacagacatacaaactaaagaattacaaaaacaaattacaaaaattcaaaattttatcgattacgcgtgtacagagagacagcagaatatgggccaaacaggatatctgtggtaagcagttcctgccccggctcagggccaagaacagttggaacagcagaatatgggccaaacaggatatctgtggtaagcagttcctgccccggctcagggccaagaacagatggtccccagatgcggtcccgccctcagcagtttctagagaaccatcagatgtttccagggtgccccaaggacctgaaatgaccctgtgccttatttgaactaaccaatcagttcgcttctcgcttctgttcgcgcgcttctgctccccgagctctatataagcagagctcgtttagtgaaccgtcagatccctgcagggccgccaccatggccctccctgtgaccgccctgctgctccccctcgccctgttgctccatgctgcccgacctggatccatcctttggcacgagatgtggcacgagggactcgaagaagcgtcccggctgtacttcggagagcggaacgtgaaggggatgttcgaagtgctggaacccctgcacgccatgatggagcggggtcctcagacccttaaagaaacaagcttcaaccaggcgtacgggcgcgacctgatggaagcccaggagtggtgccgcaagtacatgaagtccggaaacgtgaaggatctgacccaagcctgggatctgtactaccacgtgttcagaaggatctcaaaggctagcgccaagcctaccaccacccctgcccctagacctccaacacccgccccaacaatcgccagccagcctctgtctctgaggcccgaggcttgtagaccagctgctggcggagccgtacacaccagaggactggatttcgcctgcgacatctacatctgggcccctctggccggcacatgtggcgtgctgctgctgagcctcgtgatcaccatgcataagaggggacggaagaagctgctgtacattttcaagcagccattcatgcggcctgtgcaaaccacccaggaggaggacgggtgcagctgccggttccctgaggaagaggagggcggatgcgaactgcgcgtgaagttcagccggagcgcagatgctcccgcataccaacagggacagaaccagctgtataacgagctgaacctgggcagaagggaagagtacgacgtcctcgacaagcggcggggacgcgacccagaaatgggaggaaagccccgccggaagaacccgcaggaaggcctgtacaacgagttgcagaaagacaagatggctgaagcttactcggagattggcatgaagggggagagaagaagagggaagggccacgacggcctttaccaaggactgagcactgccaccaaggacacctacgatgcgctgcacatgcaggccctgcccccgcggtccggttcgggcgcgactaacttcagcctgctgaagcaggccggagatgtggaggaaaaccctggaccgtccatggagactgataccctgcttctgtgggtcctgctcctctgggtgccgggctccaccggtgacatccagatgacccagaccacctcatccctgagcgcctctctgggtgatcgcgtgactatctcctgccgggcgtcgcaggatatctccaagtacctgaactggtaccagcaaaaaccggacgggaccgtgaaactgctgatctaccatacttcccgccttcattccggagtgccctcccggttttccggctcgggttcagggactgattattcgctgaccatttccaacctggagcaggaggacattgcgacctacttctgccaacaaggaaacaccctgccctacactttcggtggtggaaccaagctcgagatcaccggatcaacctcgggcagcgggaagccgggcagcggagagggatcgacgaaaggagaagtcaagctgcaggaatccggcccgggactggtggccccgagccagtcgctctccgtcacttgcaccgtgtcgggagtgtccttgcccgactacggagtgtcatggattcggcagccacctcgcaagggcctggaatggctcggcgtgatttggggctcagaaaccacatactacaacagcgccctgaagtctcggctcaccatcatcaaggacaattccaagtcccaagtgttcctgaagatgaatagcttgcagactgacgacaccgcgatctactactgtgccaagcactactactacggcggttcctacgccatggactactggggacaaggaacttccgtgactgtctcctcccctagggggggtggtggttcgggggtccaggtggaaaccatttcccccggcgacgggcgcaccttcccgaagcgcggacagacctgtgtggtgcactataccggaatgctcgaagatggaaagaagtttgacagctccagggaccgcaacaagcctttcaagtttatgcttggaaagcaggaagtcatccggggctgggaagagggagtcgcccagatgagcgtcggccagcgggccaagctgacgatctcccctgactatgcctacggcgctaccggccatcccggaatcattccgccgcacgcaaccctcgtgttcgacgtggaattgctcaagctggaaggcggccgcatgaagatcttcatgtacctgctgaccgtgttcctgatcacccagatgatcggcagcgccctgttcgccgtgtacctgcacaggaggtgagtcgaccgagcatcttaccgccatttatacccatatttgttctgtttttcttgatttgggtatacatttaaatgttaatagaacaaaatggtggggcaatcatttacatttttagggatatgtaattactagttcaggtgtattgccacaagacaaacatgttaagaaactttcccgttatttacgctctgttcctgttaatcaacctctggattacaaaatttgtgaaagattgactgatattcttaactatgttgctccttttacgctgtgtggatatgctgctttatagcctctgtatctagctattgcttcccgtacggctttcgttttctcctccttgtataaatcctggttgctgtctcttttagaggagttgtggcccgttgtccgtcaacgtggcgtggtgtgctctgtgtttgctgacgcaacccccactggctggggcattgccaccacctgtcaactcctttctgggactttcgctttccccctcccgatcgccacggcagaactcatcgccgcctgccttgcccgctgctggacaggggctaggttgctgggcactgataattccgtggtgttgtcatcgaattcggtacctttttaaaagaaaaggggggactggaagggctaattcactcccaacgaagacaagatatcataacttcgtatagcatacattatacgaagttataatttatttgtgaaatttgtgatgctattgctttatttgtaaccatatgtttatttgtgaaatttgtgatgctattgctttatttgtaaccattgctttttgcttgtactgggtctctctggttagaccagatctgagcctgggagctctctggctaactagggaacccactgcttaagcctcaataaagcttgcctcgaccagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcctgcagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaatgaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcggt

SEQ ID NO: 90 - protein, 778 aa, Artificial Sequence
  CD8ss.FRB.CD8hinge-TM.41BB.Zeta.P2A.IgKss.CD19scFv.DmrA.CD154TM codon optimized protein
MALPVTALLLPLALLLHAARPGSILWHEMWHEGLEEASRLYFGERNVKGMFEVLEPLHAMMERGPQTLKETSFNQAYGRDLMEAQEWCRKYMKSGNVKDLTQAWDLYYHVFRRISKASAKPTTTPAPRPPTPAPTIASQPLSLRPEACRPAAGGAVHTRGLDFACDIYIWAPLAGTCGVLLLSLVITMHKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSGSGATNFSLLKQAGDVEENPGPSMETDTLLLWVLLLWVPGSTGDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSPRGGGGSGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLEGGRMKIFMYLLTVFLITQMIGSALFAVYLHRR

SEQ ID NO: 91 - DNA, 7651 bp, Artificial Sequence
  pCVL.MND.CD8ss.FRB.AMN.41BB.Zeta.P2A.IgKss.CD19scFv.DmrA.CD154TM. wPRE-Codon lentiviral vector
taacttttaaaagaaaaggggggattggggggtacagtgcaggggaaagaatagtagacataatagcaacagacatacaaactaaagaattacaaaaacaaattacaaaaattcaaaattttatcgattacgcgtgtacagagagacagcagaatatgggccaaacaggatatctgtggtaagcagttcctgccccggctcagggccaagaacagttggaacagcagaatatgggccaaacaggatatctgtggtaagcagttcctgccccggctcagggccaagaacagatggtccccagatgcggtcccgccctcagcagtttctagagaaccatcagatgtttccagggtgccccaaggacctgaaatgaccctgtgccttatttgaactaaccaatcagttcgcttctcgcttctgttcgcgcgcttctgctccccgagctctatataagcagagctcgtttagtgaaccgtcagatccctgcagggccgccaccatggccctccctgtgaccgccctgctgctccccctcgccctgttgctccatgctgcccgacctggatccatcctttggcacgagatgtggcacgagggactcgaagaagcgtcccggctgtacttcggagagcggaacgtgaaggggatgttcgaagtgctggaacccctgcacgccatgatggagcggggtcctcagacccttaaagaaacaagcttcaaccaggcgtacgggcgcgacctgatggaagcccaggagtggtgccgcaagtacatgaagtccggaaacgtgaaggatctgacccaagcctgggatctgtactaccacgtgttcagaaggatctcaaaggctagcgtttggggaagttcggccgctggacttgcgggtggcgtagccgctgcagtgctgctagcgctgctcgtcctacttgtggcgccgccgctgctgatgcataagaggggacggaagaagctgctgtacattttcaagcagccattcatgcggcctgtgcaaaccacccaggaggaggacgggtgcagctgccggttccctgaggaagaggagggcggatgcgaactgcgcgtgaagttcagccggagcgcagatgctcccgcataccaacagggacagaaccagctgtataacgagctgaacctgggcagaagggaagagtacgacgtcctcgacaagcggcggggacgcgacccagaaatgggaggaaagccccgccggaagaacccgcaggaaggcctgtacaacgagttgcagaaagacaagatggctgaagcttactcggagattggcatgaagggggagagaagaagagggaagggccacgacggcctttaccaaggactgagcactgccaccaaggacacctacgatgcgctgcacatgcaggccctgcccccgcggtccggttcgggcgcgactaacttcagcctgctgaagcaggccggagatgtggaggaaaaccctggaccgtccatggagactgataccctgcttctgtgggtcctgctcctctgggtgccgggctccaccggtgacatccagatgacccagaccacctcatccctgagcgcctctctgggtgatcgcgtgactatctcctgccgggcgtcgcaggatatctccaagtacctgaactggtaccagcaaaaaccggacgggaccgtgaaactgctgatctaccatacttcccgccttcattccggagtgccctcccggttttccggctcgggttcagggactgattattcgctgaccatttccaacctggagcaggaggacattgcgacctacttctgccaacaaggaaacaccctgccctacactttcggtggtggaaccaagctcgagatcaccggatcaacctcgggcagcgggaagccgggcagcggagagggatcgacgaaaggagaagtcaagctgcaggaatccggcccgggactggtggccccgagccagtcgctctccgtcacttgcaccgtgtcgggagtgtccttgcccgactacggagtgtcatggattcggcagccacctcgcaagggcctggaatggctcggcgtgatttggggctcagaaaccacatactacaacagcgccctgaagtctcggctcaccatcatcaaggacaattccaagtcccaagtgttcctgaagatgaatagcttgcagactgacgacaccgcgatctactactgtgccaagcactactactacggcggttcctacgccatggactactggggacaaggaacttccgtgactgtctcctcccctagggggggtggtggttcgggggtccaggtggaaaccatttcccccggcgacgggcgcaccttcccgaagcgcggacagacctgtgtggtgcactataccggaatgctcgaagatggaaagaagtttgacagctccagggaccgcaacaagcctttcaagtttatgcttggaaagcaggaagtcatccggggctgggaagagggagtcgcccagatgagcgtcggccagcgggccaagctgacgatctcccctgactatgcctacggcgctaccggccatcccggaatcattccgccgcacgcaaccctcgtgttcgacgtggaattgctcaagctggaaggcggccgcatgaagatcttcatgtacctgctgaccgtgttcctgatcacccagatgatcggcagcgccctgttcgccgtgtacctgcacaggaggtgagtcgaccgagcatcttaccgccatttatacccatatttgttctgtttttcttgatttgggtatacatttaaatgttaatagaacaaaatggtggggcaatcatttacatttttagggatatgtaattactagttcaggtgtattgccacaagacaaacatgttaagaaactttcccgttatttacgctctgttcctgttaatcaacctctggattacaaaatttgtgaaagattgactgatattcttaactatgttgctccttttacgctgtgtggatatgctgctttatagcctctgtatctagctattgcttcccgtacggctttcgttttctcctccttgtataaatcctggttgctgtctcttttagaggagttgtggcccgttgtccgtcaacgtggcgtggtgtgctctgtgtttgctgacgcaacccccactggctggggcattgccaccacctgtcaactcctttctgggactttcgctttccccctcccgatcgccacggcagaactcatcgccgcctgccttgcccgctgctggacaggggctaggttgctgggcactgataattccgtggtgttgtcatcgaattcggtacctttttaaaagaaaaggggggactggaagggctaattcactcccaacgaagacaagatatcataacttcgtatagcatacattatacgaagttataatttatttgtgaaatttgtgatgctattgctttatttgtaaccatatgtttatttgtgaaatttgtgatgctattgctttatttgtaaccattgctttttgcttgtactgggtctctctggttagaccagatctgagcctgggagctctctggctaactagggaacccactgcttaagcctcaataaagcttgcctcgaccagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcctgcagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaatgaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcggt

SEQ ID NO: 92 - protein, 740 aa, Artificial Sequence
  CD8ss.FRB.AMN.41BB.Zeta.P2A.IgKss.CD19scFv.DmrA.CD154TM codon optimized protein
MALPVTALLLPLALLLHAARPGSILWHEMWHEGLEEASRLYFGERNVKGMFEVLEPLHAMMERGPQTLKETSFNQAYGRDLMEAQEWCRKYMKSGNVKDLTQAWDLYYHVFRRISKASVWGSSAAGLAGGVAAAVLLALLVLLVAPPLLMHKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSGSGATNFSLLKQAGDVEENPGPSMETDTLLLWVLLLWVPGSTGDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSPRGGGGSGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLEGGRMKIFMYLLTVFLITQMIGSALFAVYLHRR

SEQ ID NO: 93 - DNA, 8089 bp, Artificial Sequence
  pBB.MND.CD8ss.DmrC.CD8TM.41BB.Zeta.P2A.IgKss.CD19scFv.DmrA.CD154T M-Codon lentiviral vector
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatcatatgccagcctatggtgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgggtctctctggttagaccagatctgagcctgggagctctctggctaactagggaacccactgcttaagcctcaataaagcttgccttgagtgctcaaagtagtgtgtgcccgtctgttgtgtgactctggtaactagagatccctcagacccttttagtcagtgtggaaaatctctagcagtggcgcccgaacagggacttgaaagcgaaagtaaagccagaggagatctctcgacgcaggactcggcttgctgaagcgcgcacggcaagaggcgaggggcggcgactggtgagtacgccaaaaattttgactagcggaggctagaaggagagagtagggtgcgagagcgtcggtattaagcgggggagaattagataaatgggaaaaaattcggttaaggccagggggaaagaaacaatataaactaaaacatatagttagggcaagcagggagctagaacgattcgcagttaatcctggccttttagagacatcagaaggctgtagacaaatactgggacagctacaaccatcccttcagacaggatcagaagaacttagatcattatataatacaatagcagtcctctattgtgtgcatcaaaggatagatgtaaaagacaccaaggaagccttagataagatagaggaagagcaaaacaaaagtaagaaaaaggcacagcaagcagcagctgacacaggaaacaacagccaggtcagccaaaattaccctatagtgcagaacctccaggggcaaatggtacatcaggccatatcacctagaactttaaattaagacagcagtacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggaaaggaccagcaaagctcctctggaaaggtgaaggggcagtagtaatacaagataatagtgacataaaagtagtgccaagaagaaaagcaaagatcatcagggattatggaaaacagatggcaggtgatgattgtgtggcaagtagacaggatgaggattaacacatggaaaagattagtaaaacaccatagctctagagcgatcccgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatccatctcgacggaatgaaagaccccacctgtaggtttggcaagctaggatcaaggttaggaacagagagacagcagaatatgggccaaacaggatatctgtggtaagcagttcctgccccggctcagggccaagaacagttggaacagcagaatatgggccaaacaggatatctgtggtaagcagttcctgccccggctcagggccaagaacagatggtccccagatgcggtcccgccctcagcagtttctagagaaccatcagatgtttccagggtgccccaaggacctgaaatgaccctgtgccttatttgaactaaccaatcagttcgcttctcgcttctgttcgcgcgcttctgctccccgagctcaataaaagagcccacaacccctcactcggcgcgattcacctgacgcgtctcgagggccgccaccatggccctccctgtgaccgccctgctgctccccctcgccctgttgctccatgctgcccgacctggatccatcctttggcacgagatgtggcacgagggactcgaagaagcgtcccggctgtacttcggagagcggaacgtgaaggggatgttcgaagtgctggaacccctgcacgccatgatggagcggggtcctcagacccttaaagaaacaagcttcaaccaggcgtacgggcgcgacctgatggaagcccaggagtggtgccgcaagtacatgaagtccggaaacgtgaaggatctgctgcaagcctgggatctgtactaccacgtgttcagaaggatctcaaaggctagcgccggcactggttcggatatctacatttgggcaccgctcgccggcacttgtggagtgctgttgctgtccctcgtgatcaccatgcataagaggggacggaagaagctgctgtacattttcaagcagccattcatgcggcctgtgcaaaccacccaggaggaggacgggtgcagctgccggttccctgaggaagaggagggcggatgcgaactgcgcgtgaagttcagccggagcgcagatgctcccgcataccaacagggacagaaccagctgtataacgagctgaacctgggcagaagggaagagtacgacgtcctcgacaagcggcggggacgcgacccagaaatgggaggaaagccccgccggaagaacccgcaggaaggcctgtacaacgagttgcagaaagacaagatggctgaagcttactcggagattggcatgaagggggagagaagaagagggaagggccacgacggcctttaccaaggactgagcactgccaccaaggacacctacgatgcgctgcacatgcaggccctgcccccgcggtccggttcgggcgcgactaacttcagcctgctgaagcaggccggagatgtggaggaaaaccctggaccgtccatggagactgataccctgcttctgtgggtcctgctcctctgggtgccgggctccaccggtgacatccagatgacccagaccacctcatccctgagcgcctctctgggtgatcgcgtgactatctcctgccgggcgtcgcaggatatctccaagtacctgaactggtaccagcaaaaaccggacgggaccgtgaaactgctgatctaccatacttcccgccttcattccggagtgccctcccggttttccggctcgggttcagggactgattattcgctgaccatttccaacctggagcaggaggacattgcgacctacttctgccaacaaggaaacaccctgccctacactttcggtggtggaaccaagctcgagatcaccggatcaacctcgggcagcgggaagccgggcagcggagagggatcgacgaaaggagaagtcaagctgcaggaatccggcccgggactggtggccccgagccagtcgctctccgtcacttgcaccgtgtcgggagtgtccttgcccgactacggagtgtcatggattcggcagccacctcgcaagggcctggaatggctcggcgtgatttggggctcagaaaccacatactacaacagcgccctgaagtctcggctcaccatcatcaaggacaattccaagtcccaagtgttcctgaagatgaatagcttgcagactgacgacaccgcgatctactactgtgccaagcactactactacggcggttcctacgccatggactactggggacaaggaacttccgtgactgtctcctcccctagggggggtggtggttcgggggtccaggtggaaaccatttcccccggcgacgggcgcaccttcccgaagcgcggacagacctgtgtggtgcactataccggaatgctcgaagatggaaagaagtttgacagctccagggaccgcaacaagcctttcaagtttatgcttggaaagcaggaagtcatccggggctgggaagagggagtcgcccagatgagcgtcggccagcgggccaagctgacgatctcccctgactatgcctacggcgctaccggccatcccggaatcattccgccgcacgcaaccctcgtgttcgacgtggaattgctcaagctggaaggcggccgcatgaagatcttcatgtacctgctgaccgtgttcctgatcacccagatgatcggcagcgccctgttcgccgtgtacctgcacaggaggtgagtcgactcgagtacctttaagaccaatgacttacaaggcagctgtagatcttagccactttttaaaagaaaaggggggactggaagggctaattcactcccaaagaagacaagatctgctttttgcctgtactgggtctctctggttagaccagatctgagcctgggagctctctggctaactagggaacccactgcttaagcctcaataaagcttgccttgagtgcttcaatgtgtgtgttggttttttgtgtgtcgaaattctagcgattctagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggactagctttttgcaaaagcctaggcctccaaaaaagcctcctcactacttctggaatagctcagaggccgaggcggcctcggcctctgcataaataaaaaaaattagtcagccatggggcggagaatgggcggaactgggcggagttaggggcgggatgggcggagttaggggcgggactatggttgctgactaattgagatgagcttgcatgccgacattgattattgactagtccctaagaaaccattcttatcatgacattaacctataaaaataggcgtatcacgaggccctttcgtc

SEQ ID NO: 94 - DNA, 8089 bp, Artificial Sequence
  pBB.MND.CD8ss.FRB.CD8TM.41BB.Zeta.P2A.IgKss.CD19scFv.DmrA.CD154TM -Codon lentiviral vector
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatcatatgccagcctatggtgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgggtctctctggttagaccagatctgagcctgggagctctctggctaactagggaacccactgcttaagcctcaataaagcttgccttgagtgctcaaagtagtgtgtgcccgtctgttgtgtgactctggtaactagagatccctcagacccttttagtcagtgtggaaaatctctagcagtggcgcccgaacagggacttgaaagcgaaagtaaagccagaggagatctctcgacgcaggactcggcttgctgaagcgcgcacggcaagaggcgaggggcggcgactggtgagtacgccaaaaattttgactagcggaggctagaaggagagagtagggtgcgagagcgtcggtattaagcgggggagaattagataaatgggaaaaaattcggttaaggccagggggaaagaaacaatataaactaaaacatatagttagggcaagcagggagctagaacgattcgcagttaatcctggccttttagagacatcagaaggctgtagacaaatactgggacagctacaaccatcccttcagacaggatcagaagaacttagatcattatataatacaatagcagtcctctattgtgtgcatcaaaggatagatgtaaaagacaccaaggaagccttagataagatagaggaagagcaaaacaaaagtaagaaaaaggcacagcaagcagcagctgacacaggaaacaacagccaggtcagccaaaattaccctatagtgcagaacctccaggggcaaatggtacatcaggccatatcacctagaactttaaattaagacagcagtacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggaaaggaccagcaaagctcctctggaaaggtgaaggggcagtagtaatacaagataatagtgacataaaagtagtgccaagaagaaaagcaaagatcatcagggattatggaaaacagatggcaggtgatgattgtgtggcaagtagacaggatgaggattaacacatggaaaagattagtaaaacaccatagctctagagcgatcccgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatccatctcgacggaatgaaagaccccacctgtaggtttggcaagctaggatcaaggttaggaacagagagacagcagaatatgggccaaacaggatatctgtggtaagcagttcctgccccggctcagggccaagaacagttggaacagcagaatatgggccaaacaggatatctgtggtaagcagttcctgccccggctcagggccaagaacagatggtccccagatgcggtcccgccctcagcagtttctagagaaccatcagatgtttccagggtgccccaaggacctgaaatgaccctgtgccttatttgaactaaccaatcagttcgcttctcgcttctgttcgcgcgcttctgctccccgagctcaataaaagagcccacaacccctcactcggcgcgattcacctgacgcgtctcgagggccgccaccatggccctccctgtgaccgccctgctgctccccctcgccctgttgctccatgctgcccgacctggatccatcctttggcacgagatgtggcacgagggactcgaagaagcgtcccggctgtacttcggagagcggaacgtgaaggggatgttcgaagtgctggaacccctgcacgccatgatggagcggggtcctcagacccttaaagaaacaagcttcaaccaggcgtacgggcgcgacctgatggaagcccaggagtggtgccgcaagtacatgaagtccggaaacgtgaaggatctgacccaagcctgggatctgtactaccacgtgttcagaaggatctcaaaggctagcgccggcactggttcggatatctacatttgggcaccgctcgccggcacttgtggagtgctgttgctgtccctcgtgatcaccatgcataagaggggacggaagaagctgctgtacattttcaagcagccattcatgcggcctgtgcaaaccacccaggaggaggacgggtgcagctgccggttccctgaggaagaggagggcggatgcgaactgcgcgtgaagttcagccggagcgcagatgctcccgcataccaacagggacagaaccagctgtataacgagctgaacctgggcagaagggaagagtacgacgtcctcgacaagcggcggggacgcgacccagaaatgggaggaaagccccgccggaagaacccgcaggaaggcctgtacaacgagttgcagaaagacaagatggctgaagcttactcggagattggcatgaagggggagagaagaagagggaagggccacgacggcctttaccaaggactgagcactgccaccaaggacacctacgatgcgctgcacatgcaggccctgcccccgcggtccggttcgggcgcgactaacttcagcctgctgaagcaggccggagatgtggaggaaaaccctggaccgtccatggagactgataccctgcttctgtgggtcctgctcctctgggtgccgggctccaccggtgacatccagatgacccagaccacctcatccctgagcgcctctctgggtgatcgcgtgactatctcctgccgggcgtcgcaggatatctccaagtacctgaactggtaccagcaaaaaccggacgggaccgtgaaactgctgatctaccatacttcccgccttcattccggagtgccctcccggttttccggctcgggttcagggactgattattcgctgaccatttccaacctggagcaggaggacattgcgacctacttctgccaacaaggaaacaccctgccctacactttcggtggtggaaccaagctcgagatcaccggatcaacctcgggcagcgggaagccgggcagcggagagggatcgacgaaaggagaagtcaagctgcaggaatccggcccgggactggtggccccgagccagtcgctctccgtcacttgcaccgtgtcgggagtgtccttgcccgactacggagtgtcatggattcggcagccacctcgcaagggcctggaatggctcggcgtgatttggggctcagaaaccacatactacaacagcgccctgaagtctcggctcaccatcatcaaggacaattccaagtcccaagtgttcctgaagatgaatagcttgcagactgacgacaccgcgatctactactgtgccaagcactactactacggcggttcctacgccatggactactggggacaaggaacttccgtgactgtctcctcccctagggggggtggtggttcgggggtccaggtggaaaccatttcccccggcgacgggcgcaccttcccgaagcgcggacagacctgtgtggtgcactataccggaatgctcgaagatggaaagaagtttgacagctccagggaccgcaacaagcctttcaagtttatgcttggaaagcaggaagtcatccggggctgggaagagggagtcgcccagatgagcgtcggccagcgggccaagctgacgatctcccctgactatgcctacggcgctaccggccatcccggaatcattccgccgcacgcaaccctcgtgttcgacgtggaattgctcaagctggaaggcggccgcatgaagatcttcatgtacctgctgaccgtgttcctgatcacccagatgatcggcagcgccctgttcgccgtgtacctgcacaggaggtgagtcgactcgagtacctttaagaccaatgacttacaaggcagctgtagatcttagccactttttaaaagaaaaggggggactggaagggctaattcactcccaaagaagacaagatctgctttttgcctgtactgggtctctctggttagaccagatctgagcctgggagctctctggctaactagggaacccactgcttaagcctcaataaagcttgccttgagtgcttcaatgtgtgtgttggttttttgtgtgtcgaaattctagcgattctagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggactagctttttgcaaaagcctaggcctccaaaaaagcctcctcactacttctggaatagctcagaggccgaggcggcctcggcctctgcataaataaaaaaaattagtcagccatggggcggagaatgggcggaactgggcggagttaggggcgggatgggcggagttaggggcgggactatggttgctgactaattgagatgagcttgcatgccgacattgattattgactagtccctaagaaaccattcttatcatgacattaacctataaaaataggcgtatcacgaggccctttcgtc

SEQ ID NO: 95 - DNA, 7636 bp, Artificial Sequence
  pCVL.MND.CD8ss.DmrC.CD8TM.41BB.Zeta.P2A.IgKss.CD19scFv.DmrA.CD71T M.wPRE-Codon lentiviral vector
taacttttaaaagaaaaggggggattggggggtacagtgcaggggaaagaatagtagacataatagcaacagacatacaaactaaagaattacaaaaacaaattacaaaaattcaaaattttatcgattacgcgtgtacagagagacagcagaatatgggccaaacaggatatctgtggtaagcagttcctgccccggctcagggccaagaacagttggaacagcagaatatgggccaaacaggatatctgtggtaagcagttcctgccccggctcagggccaagaacagatggtccccagatgcggtcccgccctcagcagtttctagagaaccatcagatgtttccagggtgccccaaggacctgaaatgaccctgtgccttatttgaactaaccaatcagttcgcttctcgcttctgttcgcgcgcttctgctccccgagctctatataagcagagctcgtttagtgaaccgtcagatccctgcagggccgccaccatggccctccctgtgaccgccctgctgctccccctcgccctgttgctccatgctgcccgacctggatccatcctttggcacgagatgtggcacgagggactcgaagaagcgtcccggctgtacttcggagagcggaacgtgaaggggatgttcgaagtgctggaacccctgcacgccatgatggagcggggtcctcagacccttaaagaaacaagcttcaaccaggcgtacgggcgcgacctgatggaagcccaggagtggtgccgcaagtacatgaagtccggaaacgtgaaggatctgctgcaagcctgggatctgtactaccacgtgttcagaaggatctcaaaggctagcgccggcactggttcggatatctacatttgggcaccgctcgccggcacttgtggagtgctgttgctgtccctcgtgatcaccatgcataagaggggacggaagaagctgctgtacattttcaagcagccattcatgcggcctgtgcaaaccacccaggaggaggacgggtgcagctgccggttccctgaggaagaggagggcggatgcgaactgcgcgtgaagttcagccggagcgcagatgctcccgcataccaacagggacagaaccagctgtataacgagctgaacctgggcagaagggaagagtacgacgtcctcgacaagcggcggggacgcgacccagaaatgggaggaaagccccgccggaagaacccgcaggaaggcctgtacaacgagttgcagaaagacaagatggctgaagcttactcggagattggcatgaagggggagagaagaagagggaagggccacgacggcctttaccaaggactgagcactgccaccaaggacacctacgatgcgctgcacatgcaggccctgcccccgcggtccggttcgggcgcgactaacttcagcctgctgaagcaggccggagatgtggaggaaaaccctggaccgtccatggagactgataccctgcttctgtgggtcctgctcctctgggtgccgggctccaccggtgacatccagatgacccagaccacctcatccctgagcgcctctctgggtgatcgcgtgactatctcctgccgggcgtcgcaggatatctccaagtacctgaactggtaccagcaaaaaccggacgggaccgtgaaactgctgatctaccatacttcccgccttcattccggagtgccctcccggttttccggctcgggttcagggactgattattcgctgaccatttccaacctggagcaggaggacattgcgacctacttctgccaacaaggaaacaccctgccctacactttcggtggtggaaccaagctcgagatcaccggatcaacctcgggcagcgggaagccgggcagcggagagggatcgacgaaaggagaagtcaagctgcaggaatccggcccgggactggtggccccgagccagtcgctctccgtcacttgcaccgtgtcgggagtgtccttgcccgactacggagtgtcatggattcggcagccacctcgcaagggcctggaatggctcggcgtgatttggggctcagaaaccacatactacaacagcgccctgaagtctcggctcaccatcatcaaggacaattccaagtcccaagtgttcctgaagatgaatagcttgcagactgacgacaccgcgatctactactgtgccaagcactactactacggcggttcctacgccatggactactggggacaaggaacttccgtgactgtctcctcccctagggggggtggtggttcgggggtccaggtggaaaccatttcccccggcgacgggcgcaccttcccgaagcgcggacagacctgtgtggtgcactataccggaatgctcgaagatggaaagaagtttgacagctccagggaccgcaacaagcctttcaagtttatgcttggaaagcaggaagtcatccggggctgggaagagggagtcgcccagatgagcgtcggccagcgggccaagctgacgatctcccctgactatgcctacggcgctaccggccatcccggaatcattccgccgcacgcaaccctcgtgttcgacgtggaattgctcaagctggaaggcggccgcaggtgtagtggaagtatctgctatgggactattgctgtgatcgtctttttcttgattggatttatgattggctacttgggctattgagtcgaccgagcatcttaccgccatttatacccatatttgttctgtttttcttgatttgggtatacatttaaatgttaatagaacaaaatggtggggcaatcatttacatttttagggatatgtaattactagttcaggtgtattgccacaagacaaacatgttaagaaactttcccgttatttacgctctgttcctgttaatcaacctctggattacaaaatttgtgaaagattgactgatattcttaactatgttgctccttttacgctgtgtggatatgctgctttatagcctctgtatctagctattgcttcccgtacggctttcgttttctcctccttgtataaatcctggttgctgtctcttttagaggagttgtggcccgttgtccgtcaacgtggcgtggtgtgctctgtgtttgctgacgcaacccccactggctggggcattgccaccacctgtcaactcctttctgggactttcgctttccccctcccgatcgccacggcagaactcatcgccgcctgccttgcccgctgctggacaggggctaggttgctgggcactgataattccgtggtgttgtcatcgaattcggtacctttttaaaagaaaaggggggactggaagggctaattcactcccaacgaagacaagatatcataacttcgtatagcatacattatacgaagttataatttatttgtgaaatttgtgatgctattgctttatttgtaaccatatgtttatttgtgaaatttgtgatgctattgctttatttgtaaccattgctttttgcttgtactgggtctctctggttagaccagatctgagcctgggagctctctggctaactagggaacccactgcttaagcctcaataaagcttgcctcgaccagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcctgcagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaatgaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcggt

SEQ ID NO: 96 - protein, 735 aa, Artificial Sequence
  CD8ss.DmrC.CD8TM.41BB.Zeta.P2A.IgKss.CD19scFv.DmrA.CD71TM codon optimized protein
MALPVTALLLPLALLLHAARPGSILWHEMWHEGLEEASRLYFGERNVKGMFEVLEPLHAMMERGPQTLKETSFNQAYGRDLMEAQEWCRKYMKSGNVKDLLQAWDLYYHVFRRISKASAGTGSDIYIWAPLAGTCGVLLLSLVITMHKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSGSGATNFSLLKQAGDVEENPGPSMETDTLLLWVLLLWVPGSTGDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSPRGGGGSGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLEGGRRCSGSICYGTIAVIVFFLIGFMIGYLGY

SEQ ID NO: 97 - DNA, 7575 bp, Artificial Sequence
  pCVL.MND.CD8ss.DmrC.CD8TM.41BB.Zeta.P2A.CD71TM.DmrA.CD19scFv.wPRE -Codon lentiviral vector
taacttttaaaagaaaaggggggattggggggtacagtgcaggggaaagaatagtagacataatagcaacagacatacaaactaaagaattacaaaaacaaattacaaaaattcaaaattttatcgattacgcgtgtacagagagacagcagaatatgggccaaacaggatatctgtggtaagcagttcctgccccggctcagggccaagaacagttggaacagcagaatatgggccaaacaggatatctgtggtaagcagttcctgccccggctcagggccaagaacagatggtccccagatgcggtcccgccctcagcagtttctagagaaccatcagatgtttccagggtgccccaaggacctgaaatgaccctgtgccttatttgaactaaccaatcagttcgcttctcgcttctgttcgcgcgcttctgctccccgagctctatataagcagagctcgtttagtgaaccgtcagatccctgcagggccgccaccatggccctccctgtgaccgccctgctgctccccctcgccctgttgctccatgctgcccgacctggatccatcctttggcacgagatgtggcacgagggactcgaagaagcgtcccggctgtacttcggagagcggaacgtgaaggggatgttcgaagtgctggaacccctgcacgccatgatggagcggggtcctcagacccttaaagaaacaagcttcaaccaggcgtacgggcgcgacctgatggaagcccaggagtggtgccgcaagtacatgaagtccggaaacgtgaaggatctgctgcaagcctgggatctgtactaccacgtgttcagaaggatctcaaaggctagcgccggcactggttcggatatctacatttgggcaccgctcgccggcacttgtggagtgctgttgctgtccctcgtgatcaccatgcataagaggggacggaagaagctgctgtacattttcaagcagccattcatgcggcctgtgcaaaccacccaggaggaggacgggtgcagctgccggttccctgaggaagaggagggcggatgcgaactgcgcgtgaagttcagccggagcgcagatgctcccgcataccaacagggacagaaccagctgtataacgagctgaacctgggcagaagggaagagtacgacgtcctcgacaagcggcggggacgcgacccagaaatgggaggaaagccccgccggaagaacccgcaggaaggcctgtacaacgagttgcagaaagacaagatggctgaagcttactcggagattggcatgaagggggagagaagaagagggaagggccacgacggcctttaccaaggactgagcactgccaccaaggacacctacgatgcgctgcacatgcaggccctgcccccgcggtccggttcgggcgcgactaacttcagcctgctgaagcaggccggagatgtggaggaaaaccctggaccgtccaggtgtagtggaagtatctgctatgggactattgctgtgatcgtctttttcttgattggatttatgattggctacttgggctataccggtggggtccaggtggaaaccatttcccccggcgacgggcgcaccttcccgaagcgcggacagacctgtgtggtgcactataccggaatgctcgaagatggaaagaagtttgacagctccagggaccgcaacaagcctttcaagtttatgcttggaaagcaggaagtcatccggggctgggaagagggagtcgcccagatgagcgtcggccagcgggccaagctgacgatctcccctgactatgcctacggcgctaccggccatcccggaatcattccgccgcacgcaaccctcgtgttcgacgtggaattgctcaagctggaagggggtggtggttcgcctagggacatccagatgacccagaccacctcatccctgagcgcctctctgggtgatcgcgtgactatctcctgccgggcgtcgcaggatatctccaagtacctgaactggtaccagcaaaaaccggacgggaccgtgaaactgctgatctaccatacttcccgccttcattccggagtgccctcccggttttccggctcgggttcagggactgattattcgctgaccatttccaacctggagcaggaggacattgcgacctacttctgccaacaaggaaacaccctgccctacactttcggtggtggaaccaagctcgagatcaccggatcaacctcgggcagcgggaagccgggcagcggagagggatcgacgaaaggagaagtcaagctgcaggaatccggcccgggactggtggccccgagccagtcgctctccgtcacttgcaccgtgtcgggagtgtccttgcccgactacggagtgtcatggattcggcagccacctcgcaagggcctggaatggctcggcgtgatttggggctcagaaaccacatactacaacagcgccctgaagtctcggctcaccatcatcaaggacaattccaagtcccaagtgttcctgaagatgaatagcttgcagactgacgacaccgcgatctactactgtgccaagcactactactacggcggttcctacgccatggactactggggacaaggaacttccgtgactgtctcctcctgagcggccgccgagcatcttaccgccatttatacccatatttgttctgtttttcttgatttgggtatacatttaaatgttaatagaacaaaatggtggggcaatcatttacatttttagggatatgtaattactagttcaggtgtattgccacaagacaaacatgttaagaaactttcccgttatttacgctctgttcctgttaatcaacctctggattacaaaatttgtgaaagattgactgatattcttaactatgttgctccttttacgctgtgtggatatgctgctttatagcctctgtatctagctattgcttcccgtacggctttcgttttctcctccttgtataaatcctggttgctgtctcttttagaggagttgtggcccgttgtccgtcaacgtggcgtggtgtgctctgtgtttgctgacgcaacccccactggctggggcattgccaccacctgtcaactcctttctgggactttcgctttccccctcccgatcgccacggcagaactcatcgccgcctgccttgcccgctgctggacaggggctaggttgctgggcactgataattccgtggtgttgtcatcgaattcggtacctttttaaaagaaaaggggggactggaagggctaattcactcccaacgaagacaagatatcataacttcgtatagcatacattatacgaagttataatttatttgtgaaatttgtgatgctattgctttatttgtaaccatatgtttatttgtgaaatttgtgatgctattgctttatttgtaaccattgctttttgcttgtactgggtctctctggttagaccagatctgagcctgggagctctctggctaactagggaacccactgcttaagcctcaataaagcttgcctcgaccagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcctgcagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaatgaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcggt

SEQ ID NO: 98 - protein, 714 aa, Artificial Sequence
  CD8ss.DmrC.CD8TM.41BB.Zeta.P2A.CD71TM.DmrA.CD19scFv codon optimized protein
MALPVTALLLPLALLLHAARPGSILWHEMWHEGLEEASRLYFGERNVKGMFEVLEPLHAMMERGPQTLKETSFNQAYGRDLMEAQEWCRKYMKSGNVKDLLQAWDLYYHVFRRISKASAGTGSDIYIWAPLAGTCGVLLLSLVITMHKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSGSGATNFSLLKQAGDVEENPGPSRCSGSICYGTIAVIVFFLIGFMIGYLGYTGGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLEGGGGSPRDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSS

SEQ ID NO: 99 - DNA, 7671 bp, Artificial Sequence
  pCVL.MND.CD8ss.FRB.CD8Hinge.CD8TM.41BB.Zeta.P2A.IgKss.CD19scFv.Dm rA.wPRE-Codon lentiviral vector
aacttttaaaagaaaaggggggattggggggtacagtgcaggggaaagaatagtagacataatagcaacagacatacaaactaaagaattacaaaaacaaattacaaaaattcaaaattttatcgattacgcgtgtacagagagacagcagaatatgggccaaacaggatatctgtggtaagcagttcctgccccggctcagggccaagaacagttggaacagcagaatatgggccaaacaggatatctgtggtaagcagttcctgccccggctcagggccaagaacagatggtccccagatgcggtcccgccctcagcagtttctagagaaccatcagatgtttccagggtgccccaaggacctgaaatgaccctgtgccttatttgaactaaccaatcagttcgcttctcgcttctgttcgcgcgcttctgctccccgagctctatataagcagagctcgtttagtgaaccgtcagatccctgcagggccgccaccatggccctccctgtgaccgccctgctgctccccctcgccctgttgctccatgctgcccgacctggatccatcctttggcacgagatgtggcacgagggactcgaagaagcgtcccggctgtacttcggagagcggaacgtgaaggggatgttcgaagtgctggaacccctgcacgccatgatggagcggggtcctcagacccttaaagaaacaagcttcaaccaggcgtacgggcgcgacctgatggaagcccaggagtggtgccgcaagtacatgaagtccggaaacgtgaaggatctgacccaagcctgggatctgtactaccacgtgttcagaaggatctcaaaggctagcgccaagcctaccaccacccctgcccctagacctccaacacccgccccaacaatcgccagccagcctctgtctctgaggcccgaggcttgtagaccagctgctggcggagccgtacacaccagaggactggatttcgcctgcgacatctacatctgggcccctctggccggcacatgtggcgtgctgctgctgagcctcgtgatcaccatgcataagaggggacggaagaagctgctgtacattttcaagcagccattcatgcggcctgtgcaaaccacccaggaggaggacgggtgcagctgccggttccctgaggaagaggagggcggatgcgaactgcgcgtgaagttcagccggagcgcagatgctcccgcataccaacagggacagaaccagctgtataacgagctgaacctgggcagaagggaagagtacgacgtcctcgacaagcggcggggacgcgacccagaaatgggaggaaagccccgccggaagaacccgcaggaaggcctgtacaacgagttgcagaaagacaagatggctgaagcttactcggagattggcatgaagggggagagaagaagagggaagggccacgacggcctttaccaaggactgagcactgccaccaaggacacctacgatgcgctgcacatgcaggccctgcccccgcggtccggttcgggcgcgactaacttcagcctgctgaagcaggccggagatgtggaggaaaaccctggaccgtccatggagactgataccctgcttctgtgggtcctgctcctctgggtgccgggctccaccggtgacatccagatgacccagaccacctcatccctgagcgcctctctgggtgatcgcgtgactatctcctgccgggcgtcgcaggatatctccaagtacctgaactggtaccagcaaaaaccggacgggaccgtgaaactgctgatctaccatacttcccgccttcattccggagtgccctcccggttttccggctcgggttcagggactgattattcgctgaccatttccaacctggagcaggaggacattgcgacctacttctgccaacaaggaaacaccctgccctacactttcggtggtggaaccaagctcgagatcaccggatcaacctcgggcagcgggaagccgggcagcggagagggatcgacgaaaggagaagtcaagctgcaggaatccggcccgggactggtggccccgagccagtcgctctccgtcacttgcaccgtgtcgggagtgtccttgcccgactacggagtgtcatggattcggcagccacctcgcaagggcctggaatggctcggcgtgatttggggctcagaaaccacatactacaacagcgccctgaagtctcggctcaccatcatcaaggacaattccaagtcccaagtgttcctgaagatgaatagcttgcagactgacgacaccgcgatctactactgtgccaagcactactactacggcggttcctacgccatggactactggggacaaggaacttccgtgactgtctcctcccctagggggggtggtggttcgggggtccaggtggaaaccatttcccccggcgacgggcgcaccttcccgaagcgcggacagacctgtgtggtgcactataccggaatgctcgaagatggaaagaagtttgacagctccagggaccgcaacaagcctttcaagtttatgcttggaaagcaggaagtcatccggggctgggaagagggagtcgcccagatgagcgtcggccagcgggccaagctgacgatctcccctgactatgcctacggcgctaccggccatcccggaatcattccgccgcacgcaaccctcgtgttcgacgtggaattgctcaagctggaataggcggccgccgagcatcttaccgccatttatacccatatttgttctgtttttcttgatttgggtatacatttaaatgttaatagaacaaaatggtggggcaatcatttacatttttagggatatgtaattactagttcaggtgtattgccacaagacaaacatgttaagaaactttcccgttatttacgctctgttcctgttaatcaacctctggattacaaaatttgtgaaagattgactgatattcttaactatgttgctccttttacgctgtgtggatatgctgctttatagcctctgtatctagctattgcttcccgtacggctttcgttttctcctccttgtataaatcctggttgctgtctcttttagaggagttgtggcccgttgtccgtcaacgtggcgtggtgtgctctgtgtttgctgacgcaacccccactggctggggcattgccaccacctgtcaactcctttctgggactttcgctttccccctcccgatcgccacggcagaactcatcgccgcctgccttgcccgctgctggacaggggctaggttgctgggcactgataattccgtggtgttgtcatcgaattcggtacctttttaaaagaaaaggggggactggaagggctaattcactcccaacgaagacaagatatcataacttcgtatagcatacattatacgaagttataatttatttgtgaaatttgtgatgctattgctttatttgtaaccatatgtttatttgtgaaatttgtgatgctattgctttatttgtaaccattgctttttgcttgtactgggtctctctggttagaccagatctgagcctgggagctctctggctaactagggaacccactgcttaagcctcaataaagcttgcctcgaccagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcctgcagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaatgaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcggtt

SEQ ID NO: 100 - protein, 746 aa, Artificial Sequence
  CD8ss.FRB.CD8Hinge.CD8TM.41BB.Zeta.P2A.IgKss.CD19scFv.DmrA codon optimized protein
MALPVTALLLPLALLLHAARPGSILWHEMWHEGLEEASRLYFGERNVKGMFEVLEPLHAMMERGPQTLKETSFNQAYGRDLMEAQEWCRKYMKSGNVKDLTQAWDLYYHVFRRISKASAKPTTTPAPRPPTPAPTIASQPLSLRPEACRPAAGGAVHTRGLDFACDIYIWAPLAGTCGVLLLSLVITMHKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSGSGATNFSLLKQAGDVEENPGPSMETDTLLLWVLLLWVPGSTGDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSPRGGGGSGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLE

What is claimed is:

1. An isolated non-natural cell comprising:
(a) a first nucleic acid molecule encoding a first fusion protein comprising a first multimerization domain comprising an FRB T2098L polypeptide, a CD8a transmembrane domain, a costimulatory domain of 4-1BB, and an actuator domain of CD3, wherein the first multimerization domain localizes extracellularly when the first fusion protein is expressed; and
(b) a second nucleic acid molecule encoding a second fusion protein comprising a binding domain comprising a single chain antibody variable region (scFv) specific for CD19 or B cell maturation antigen (BCMA), a second multimerization domain comprising an FKBP12 polypeptide, and a CD4, a CD154 or a CD71 transmembrane domain, wherein the second multimerization domain localizes extracellularly when the first fusion protein is expressed;
wherein the first fusion protein and the second fusion protein are each expressed as separate fusion proteins and form a polypeptide complex on the non-natural cell surface in the presence of a bridging factor, rapalog AP21967; and
wherein the bridging factor is associated with and disposed between the first and second multimerization domains.

2. An isolated non-natural cell comprising:
(a) a first nucleic acid molecule encoding a first fusion protein comprising a first multimerization domain comprising an FRB polypeptide, a CD8a transmembrane domain, a costimulatory domain of 4-1BB, and an actuator domain of CD3, wherein the first multimerization domain localizes extracellularly when the first fusion protein is expressed; and
(b) a second nucleic acid molecule encoding a second fusion protein comprising a binding domain comprising an scFv specific for CD19 or BCMA, a second multimerization domain comprising an FKBP12 polypeptide, and a CD4, a CD154 or a CD71 transmembrane domain as a second transmembrane domain, wherein the second multimerization domain localizes extracellularly when the first fusion protein is expressed;
wherein the first fusion protein and the second fusion protein are each expressed as separate fusion proteins and form a polypeptide complex on the non-natural cell surface in the presence of a bridging factor selected from the group consisting of: Rapamycin, temsirolimus or everolimus; and
wherein the bridging factor is associated with and disposed between the first and second multimerization domains.

3. An isolated non-natural cell comprising:
(a) a first nucleic acid molecule encoding a first fusion protein comprising a first multimerization domain comprising an FRB T2098L polypeptide, a AMN transmembrane domain, a costimulatory domain of 4-1BB, and an actuator domain of CD3, wherein the first multimerization domain localizes extracellularly when the first fusion protein is expressed; and
(b) a second nucleic acid molecule encoding a second fusion protein comprising a binding domain comprising an scFv specific for CD19 or BCMA, a second multimerization domain comprising an FKBP12 polypeptide, and a CD154 transmembrane domain as a second transmembrane domain, wherein the second multimerization domain localizes extracellularly when the first fusion protein is expressed;
wherein the first fusion protein and the second fusion protein are each expressed as separate fusion proteins and form a polypeptide complex on the non-natural cell surface in the presence of a bridging factor, rapalog AP21967; and
wherein the bridging factor is associated with and disposed between the first and second multimerization domains.

4. An isolated non-natural cell comprising:
(a) a first nucleic acid molecule encoding a first fusion protein comprising a first multimerization domain comprising an FRB polypeptide, a AMN transmembrane domain, a costimulatory domain of 4-1BB, and an actuator domain of CD3, wherein the first multimerization domain localizes extracellularly when the first fusion protein is expressed; and
(b) a second nucleic acid molecule encoding a second fusion protein comprising a binding domain comprising an scFv specific for CD19 or BCMA, a second multimerization domain comprising an FKBP12 polypeptide, and a CD154 transmembrane domain as a second transmembrane domain, wherein the second multimerization domain localizes extracellularly when the first fusion protein is expressed;
wherein the first fusion protein and the second fusion protein are each expressed as separate fusion proteins and form a polypeptide complex on the non-natural cell surface in the presence of a bridging factor selected from the group consisting of: Rapamycin, temsirolimus or everolimus; and
wherein the bridging factor is associated with and disposed between the first and second multimerization domains.

* * * * *

UNITED STATES PATENT AND TRADEMARK OFFICE
CERTIFICATE OF CORRECTION

PATENT NO. : 10,428,142 B2
APPLICATION NO. : 14/608098
DATED : October 1, 2019
INVENTOR(S) : Jarjour et al.

Page 1 of 1

It is certified that error appears in the above-identified patent and that said Letters Patent is hereby corrected as shown below:

In the Claims

Claim 1 at Column 83, Lines 5-7, that portion reading "a CD8a transmembrane domain, a costimulatory domain of 4-1BB, and an actuator domain of CD3" should read "a CD8α transmembrane domain, a costimulatory domain of 4-1BB, and an actuator domain of CD3ζ".

Claim 2 at Column 83, Lines 30-32, that portion reading "a CD8a transmembrane domain, a costimulatory domain of 4-1BB, and an actuator domain of CD3" should read "a CD8α transmembrane domain, a costimulatory domain of 4-1BB, and an actuator domain of CD3ζ".

Claim 3 at Column 84, Line 6, that portion reading "and an actuator domain of CD3" should read "and an actuator domain of CD3ζ".

Claim 4 at Column 84, Line 32, that portion reading "actuator domain of CD3" should read "actuator domain of CD3ζ".

Signed and Sealed this
Third Day of December, 2019

Andrei Iancu
*Director of the United States Patent and Trademark Office*